United States Patent
Lee et al.

(10) Patent No.: US 7,932,031 B2
(45) Date of Patent: Apr. 26, 2011

(54) METHODS FOR DETERMINING SENSITIVITY TO MICROTUBULE-STABILIZING AGENTS COMPRISING IXABEPILONE BY MEASURING THE LEVEL OF ESTROGEN RECEPTOR 1

(75) Inventors: Hyerim Lee, Princeton, NJ (US); Peter Shaw, Yardley, PA (US); Edwin A. Clark, Pennington, NJ (US)

(73) Assignee: Bristol-Myers Squibb Company, Princeton, NJ (US)

( * ) Notice: Subject to any disclaimer, the term of this patent is extended or adjusted under 35 U.S.C. 154(b) by 0 days.

(21) Appl. No.: 11/906,248

(22) Filed: Oct. 1, 2007

(65) Prior Publication Data

US 2008/0318228 A1    Dec. 25, 2008

Related U.S. Application Data

(63) Continuation of application No. 11/289,102, filed on Nov. 29, 2005, now abandoned.

(60) Provisional application No. 60/631,993, filed on Nov. 30, 2004.

(51) Int. Cl.
*C12Q 1/68*    (2006.01)
(52) U.S. Cl. .......................................................... 435/6
(58) Field of Classification Search .................. None
See application file for complete search history.

(56) References Cited

U.S. PATENT DOCUMENTS

| | | | |
|---|---|---|---|
| 5,569,588 A | 10/1996 | Ashby et al. | |
| 2002/0051978 A1 | 5/2002 | Roth et al. | |
| 2003/0166223 A1 | 9/2003 | Sims et al. | |

FOREIGN PATENT DOCUMENTS

| | | |
|---|---|---|
| WO | WO 93/10121 | 5/1993 |
| WO | WO 98/22461 | 5/1998 |
| WO | WO 98/25929 | 6/1998 |
| WO | WO 99/01124 | 1/1999 |
| WO | WO 99/02514 | 1/1999 |
| WO | WO 99/03848 | 1/1999 |
| WO | WO 99/07692 | 2/1999 |
| WO | WO 99/16416 | 4/1999 |
| WO | WO 99/39694 | 8/1999 |
| WO | WO 99/42602 | 8/1999 |
| WO | WO 99/43320 | 9/1999 |
| WO | WO 00/39276 | 7/2000 |
| WO | WO 00/58254 | 10/2000 |
| WO | WO 00/66589 | 11/2000 |
| WO | WO 01/81342 | 11/2001 |
| WO | WO 02/14323 | 2/2002 |
| WO | WO 02/067941 | 9/2002 |
| WO | WO 02/072085 | 9/2002 |
| WO | WO 02/074042 | 9/2002 |
| WO | WO 02/098868 | 12/2002 |
| WO | WO 03/007924 | 1/2003 |
| WO | WO 03/022844 | 3/2003 |
| WO | WO 03/057217 | 7/2003 |
| WO | WO 03/070170 | 8/2003 |
| WO | WO 03/074053 | 9/2003 |
| WO | WO 03/077903 | 9/2003 |
| WO | WO 03/078411 | 9/2003 |
| WO | WO 03/092683 | 11/2003 |
| WO | WO 03/103712 | 12/2003 |
| WO | WO 2004/014919 | 2/2004 |
| WO | WO 2004/056832 | 7/2004 |
| WO | WO 2004/080458 | 9/2004 |

OTHER PUBLICATIONS

Tockman et al (Cancer Res., 1992, 52:2711s-2718s).*
Buzdar et al (Clinical Breast Cancer, 2008, Suppl 2:S71-8).*
Baselga et al (J Clinical Oncology, 2009, 27:526-534).*
Pusztai (Annals of Oncology, 2007, 18 (Supplement 12): xii15-xii20).*
Iwao et al (Cancer, 2000, 89:1732-1738).*
Alldridge, L.C. et al., "Annexin 1 regulates cell proliferation by disruption of cell morphology and inhibition of cyclin D1 expression through sustained activation of the ERK1/2 MAPK signal", Experimental Cell Research, vol. 290, pp. 93-107, 2003.
Allzadeh, A. et al., "Distinct types of diffuse large B-cell lymphoma identified by gene expression profiling", Nature, vol. 403, pp. 503-511, 2000.
Alon, U. et al., "Broad patterns of gene expression revealed by clustering analysis of tumor and normal colon tissues probed by oligonucleotide arrays", P.N.A.S., vol. 96, pp. 6745-6750, 1999.
Ayers, M. et al., "Gene expression profiles predict complete pathologic response to Neoadjuvant Paclitaxel and Fluorouracil, Doxorubicin, and Cyclophosphamide Chemotherapy in Breast Cancer", J. of Clinical Oncology, vol. 22(12), pp. 2284-2293, 2004.
Berti, C. et al., "Mig12, a novel Opitz syndrome gene product partner, is expressed in the embryonic ventral midlines and co-operates with Mid1 to bundle and stabilize microtubules", BMC Cell Biology, vol. 5(9), pp. 1-12, 2004.
Blanchard, A. P. et al., "Sequence to array: Probing the genome's secrets", Nature Biotechnology, vol. 14, pp. 1649, 1996.
Bittner, M. et al., "Molecular classification of cutaneous malignant melanoma by gene expression profiling", Nature, vol. 406, pp. 536-540, 2000.
Bode, C.J. et al., "Epothilone and Paclitaxel: Unexpected Differences in Promoting the Assembly and Stabilization of Yeast Microtubules", Biochemistry, vol. 41, pp. 3870-3874, 2002.
Chang, J.C. et al., "Gene expression profiling for the prediction of therapeutic response to docetaxel in patients with breast cancer", The Lancet, vol. 362, pp. 362-368, 2003.

(Continued)

*Primary Examiner* — Laura B Goddard
(74) *Attorney, Agent, or Firm* — Paul D. Golian

(57) ABSTRACT

Biomarkers that are useful for identifying a mammal that will respond therapeutically or is responding therapeutically to a method of treating cancer that comprises administering a microtubule-stabilizing agent. In one aspect, the cancer is breast cancer, and the microtubule-stabilizing agent is an epothilone or analog or derivative thereof, or ixabepilone.

2 Claims, 10 Drawing Sheets
(3 of 10 Drawing Sheet(s) Filed in Color)

OTHER PUBLICATIONS

Cockett, M. et al., "Applied genomics: integration of the technology within pharmaceutical research and development", Current Opinion in Biotechnology, vol. 11, pp. 602-609, 2000.

David, Della C. et al., "Proteasomal degradation of tau protein", J. of Neurochemistry, vol. 83, pp. 176-185, 2002.

Dye, R. et al., "Taxol-induced Flexibility of Microtubules and Its Reversal by MAP-2 and Tau*", The J. of Biological Chemistry, vol. 268(10) pp. 6847-6850, 1993.

Giannakakou, P. et al., "A common pharmacophore for epothilone and taxanes: Molecular basis for drug resistance conferred by tubulin mutations in human cancer cells", PNAS, vol. 97(6), pp. 2904-2909, 2000.

Glinsky, G.V. et al., "Gene expression profiling predicts clinical outcome of prostate cancer", The J. of Clinical Investigation, vol. 113(6), pp. 913-923, 2004.

Golub, T.R. et al., "Molecular Classification of Cancer: Class Discovery and Class Prediction by Gene Expression Monitoring", Science, vol. 286, pp. 531-537, 1999.

Gottesman, M.M. et al., "Multidrug Resistance in Cancer: Role of ATP-Dependent Transporters", Nature Reviews Cancer, vol. 2, pp. 48-58, 2002.

Hsieh, F.Y. et al., "A Simple Method of Sample Size Calculation for Linear and Logistic Regression", Statistics in Medicine, vol. 17, pp. 1623-1634, 1998.

Kar, S. et al., "Repeat motifs of tau bind to the insides of microtubules in the absence of taxol", The EMBO Journal, vol. 22(1), pp. 70-77, 2003.

Khan, J. et al., "Classification and diagnostic prediction of cancers using gene expression profiling and artificial neural networks", Nature Medicine, vol. 7(6), pp. 673-679, 2001.

Khan, J. et al., "Gene Expression Profiling of Alveolar Rhabdomyosarcoma with cDNA Microarrays", Cancer Research, vol. 58, pp. 5009-5013, 1998.

Leonessa, F. et al., "ATP binding cassette transporters and drug resistance in breast cancer", Endocrine-Related Cancer, vol. 10, pp. 43-73, 2003.

Lockhart, D.J. et al., "Expression monitoring by hybridization to high-density obligonucleotide arrays", Nature Biotechnology, vol. 14, pp. 1675-1680, 1996.

Rouzier, R. et al., "Microtubule-associated protein tau: A marker of paclitaxel sensitivity in breast cancer", PNAS, vol. 102(23), pp. 8315-8320, 2005.

Sataloff, D.M. et al., "Pathologic response to induction chemotherapy in locally advanced carcinoma of the Breast: A Determinant of Outcome", J. Am. Coll. Surg., vol. 180, pp. 297-304, 1995.

Schena, M. et al., "Quantitative Monitoring of Gene Expression Patterns with a Complementary DNA Microarray", Science, vol. 270, pp. 467-470, 1995.

Shipp, M.A. et al., "Diffuse large B-cell lymphoma outcome prediction by gene-expression profiling and supervised machine learning", Nature Medicine, vol. 8(1), pp. 68-74, 2002.

Sonneveld, P, "Multidrug resistance in haematological malignancies", J. of Internal Medicine, vol. 247, pp. 521-534, 2000.

Sorlie, T. et al., "Gene expression patterns of breast carcinomas distinguish tumor subclasses with clinical implications", PNAS, vol. 98(19), pp. 10869-10874, 2001.

Staunton, J.E., "Chemosensitivity prediction by transcriptional profiling", PNAS, vol. 98(19), pp. 10787-10792, 2001.

Van't Veer, L.J., "Gene expression profiling predicts clinical outcome of breast cancer", Nature, vol. 415, pp. 530-536, 2002.

Voorhees, P. M. et al., "The Proteasome as a Target for Cancer Therapy", Clinical Cancer Research, vol. 9, pp. 6316-6325, 2003.

Wagner, P. et al., "Microtubule Associated Protein (MAP)-Tau", Cell Cycle, vol. 4(9), pp. 1149-1152, 2005.

Wands, J.R. et al., "High Affinity Monoclonal Antibodies to Hepatitis B Surface Antigen (HB,Ag) Produced by Somatic Cell Hybrids", Gastroenterology, vol. 80, pp. 225-232, 1981.

West, M, et al., "Predicting the clinical status of human breast cancer by using gene expression profiles". PNAS vol. 98(20), pp. 11462-11467, 2001.

Clopper, C.J. et al., "The use of Confidence or Fiducial Limits Illustrated in the case of the Binomial", Biometrika, vol. 26, pp. 404-413, 1934.

Altmann, Karl-Heinz, "Microtubule-stabilizing agents: a growing class of important anticancer drugs", Current Opinion in Chemical Biology, vol. 5, pp. 424-431 (2001).

Di Leo, A., "Predictive molecular markers in the adjuvant therapy of breast cancer: state of the art in the year 2002", Int. J. Clinical Oncology, vol. 7, pp. 245-253 (2002).

Duffy, Michael J., "Predictive Markers in Breast and Other Cancers: A Review", Clinical Chemistry, vol. 51(3), pp. 494-503 (2005).

Candelaria et al., International Seminars in Surgical Oncology, vol. 3, pp. 1-9 (2006).

Denduluri et al., Investigative New Drugs, vol. 25, pp. 63-67 (2006).

Dressman et al., Clinical Cancer Research, vol. 12, pp. 819-826 (2006).

Gajdos et al., J. of Surgical Oncology, vol. 80, pp. 4-11 (2002).

Greenbaum et al., Genome Biology, vol. 4(9), pp. 117.1-117.8 (2003).

Hartley et al., British J. of Radiology, vol. 78, pp. 934-938 (2005).

Huang et al., Recent Progress in Hormone Research, vol. 58, pp. 55-73 (2003).

Slamon et al., Science, vol. 235, pp. 177-182 (1987).

Swain, "New Insights into Epothilones" in New Approaches in the Treatment of Metastatic Breast Cancer, Continuing Medical Education, pp. 3-8 (2006).

Tockman et al., Cancer Research, vol. 52, pp. 2711s-2718s (1992).

* cited by examiner

FIG. 8

METHODS FOR DETERMINING SENSITIVITY TO MICROTUBULE-STABILIZING AGENTS COMPRISING IXABEPILONE BY MEASURING THE LEVEL OF ESTROGEN RECEPTOR 1

This application claims the benefit of U.S. Provisional Application No. 60/631,993 filed Nov. 30, 2004, and is a continuation of U.S. Non-Provisional application Ser. No. 11/289,102 filed Nov. 29, 2005 now abandoned, whose contents are hereby incorporated by reference in there entirety.

SEQUENCE LISTING

A compact disc labeled "Copy 1" contains the Sequence Listing as 10338 NP.ST25.txt. The Sequence Listing is 1686 KB in size and was recorded Nov. 29, 2005. The compact disk is 1 of 2 compact disks. A duplicate copy of the compact disc is labeled "Copy 2" and is 2 of 2 compact discs.

The compact disc and duplicate copy are identical and are hereby incorporated by reference into the present application.

FIELD OF THE INVENTION

The present invention relates generally to the field of pharmacogenomics, and more specifically to methods and procedures to determine drug sensitivity in patients to allow the identification of individualized genetic profiles which will aid in treating diseases and disorders.

BACKGROUND OF THE INVENTION

Cancer is a disease with extensive histoclinical heterogeneity. Although conventional histological and clinical features have been correlated to prognosis, the same apparent prognostic type of tumors varies widely in its responsiveness to therapy and consequent survival of the patient.

New prognostic and predictive markers, which would facilitate an individualization of therapy for each patient, are needed to accurately predict patient response to treatments, such as small molecule or biological molecule drugs, in the clinic. The problem may be solved by the identification of new parameters that could better predict the patient's sensitivity to treatment. The classification of patient samples is a crucial aspect of cancer diagnosis and treatment. The association of a patient's response to a treatment with molecular and genetic markers can open up new opportunities for treatment development in non-responding patients, or distinguish a treatment's indication among other treatment choices because of higher confidence in the efficacy. Further, the pre-selection of patients who are likely to respond well to a medicine, drug, or combination therapy may reduce the number of patients needed in a clinical study or accelerate the time needed to complete a clinical development program (M. Cockett et al., Current Opinion in Biotechnology, 11:602-609 (2000)).

The ability to predict drug sensitivity in patients is particularly challenging because drug responses reflect not only properties intrinsic to the target cells, but also a host's metabolic properties. Efforts to use genetic information to predict drug sensitivity have primarily focused on individual genes that have broad effects, such as the multidrug resistance genes, mdr1 and mrp1 (P. Sonneveld, J. Intern. Med., 247: 521-534 (2000)).

The development of microarray technologies for large scale characterization of gene mRNA expression pattern has made it possible to systematically search for molecular markers and to categorize cancers into distinct subgroups not evident by traditional histopathological methods (J. Khan et al., Cancer Res., 58:5009-5013 (1998); A. A. Alizadeh et al., Nature, 403:503-511 (2000); M. Bittner et al., Nature, 406: 536-540 (2000); J. Khan et al., Nature Medicine, 7(6):673-679 (2001); T. R. Golub et al., Science, 286:531-537 (1999); U. Alon et al., P. N. A. S. USA, 96:6745-6750 (1999)). Such technologies and molecular tools have made it possible to monitor the expression level of a large number of transcripts within a cell population at any given time (see, e.g., Schena et al., Science, 270:467-470 (1995); Lockhart et al., Nature Biotechnology, 14:1675-1680 (1996); Blanchard et al., Nature Biotechnology, 14:1649 (1996); U.S. Pat. No. 5,569, 588 to Ashby et al.).

Recent studies demonstrate that gene expression information generated by microarray analysis of human tumors can predict clinical outcome (L. J. van't Veer et al., Nature, 415: 530-536 (2002); T. Sorlie et al., P. N. A. S. USA, 98:10869-10874 (2001); M. Shipp et al., Nature Medicine, 8(1):68-74 (2002); G. Glinsky et al., The Journal of Clin. Invest., 113(6): 913-923 (2004)). These findings bring hope that cancer treatment will be vastly improved by better predicting the response of individual tumors to therapy.

Needed are new and alternative methods and procedures to determine drug sensitivity in patients to allow the development of individualized genetic profiles which are necessary to treat diseases and disorders based on patient response at a molecular level.

SUMMARY OF THE INVENTION

The invention provides methods and procedures for determining patient sensitivity to one or more microtubule-stabilizing agents. The invention also provides methods of determining or predicting whether an individual requiring therapy for a disease state such as cancer will or will not respond to treatment, prior to administration of the treatment, wherein the treatment comprises administration of one or more microtubule-stabilizing agents.

In one aspect, the invention provides a method for identifying a mammal that will respond therapeutically to a method of treating cancer comprising administering a microtubule-stabilizing agent, wherein the method comprises: (a) measuring in the mammal the level of at least one biomarker selected from the biomarkers of Table 1 and Table 2; (b) exposing a biological sample from the mammal to the agent; (c) following the exposing in step (b), measuring in said biological sample the level of the at least one biomarker, wherein an increase in the level of the at least one biomarker measured in step (c) compared to the level of the at least one biomarker measured in step (a), predicts that the mammal will respond therapeutically to said method of treating cancer when said biomarker is from Table 1, and predicts that the mammal will not respond therapeutically to said method of treating cancer when said biomarker is from Table 2.

In another aspect, the invention provides a method for determining whether a mammal is responding therapeutically to a microtubule-stabilizing agent, comprising (a) exposing the mammal to the agent; and (b) following the exposing of step (a), measuring in the mammal the level of at least one biomarker selected from the biomarkers of Table 1 and Table 2, wherein an increase in the level of the at least one biomarker measured in step (b), compared to the level of the at least one biomarker in a mammal that has not been exposed to said agent, indicates that the mammal is responding to said agent when said biomarker is from Table 1, and indicates that the mammal is not responding to said agent when said biomarker is from Table 2.

In another aspect, the invention provides a method for predicting whether a mammal will respond therapeutically to a method of treating cancer comprising administering a microtubule-stabilizing agent, wherein the method comprises: (a) exposing a biological sample from the mammal to the microtubule-stabilizing agent; (b) following the exposing of step (a), measuring in said biological sample the level of at least one biomarker selected from the biomarkers of Table 1 or Table 2, wherein an increase in the level of the at least one biomarker measured in step (b), compared to the level of the at least one biomarker in a mammal that has not been exposed to said agent, predicts that the mammal will respond therapeutically to said method of treating cancer when said biomarker is from Table 1, and predicts that the mammal will not respond therapeutically to said method of treating cancer when said biomarker is from Table 2.

In another aspect, the invention provides a method for determining whether an agent stabilizes microtubules and has cytotoxic activity against rapidly proliferating cells, such as, tumor cells or other hyperproliferative cellular disease in a mammal, comprising: (a) exposing the mammal to the agent; and (b) following the exposing of step (a), measuring in the mammal the level of at least one biomarker selected from the biomarkers of Table 1 and Table 2, wherein an increase in the level of said at least one biomarker measured in step (b), compared to the level of the biomarker in a mammal that has not been exposed to said agent, indicates that the agent stabilizes microtubules and has cytotoxic activity against rapidly proliferating cells when said biomarker is from Table 1, and indicates that the agent does not stabilize microtubules and does not have cytotoxic activity against rapidly proliferating cells when said biomarker is from Table 2.

As used herein, respond therapeutically refers to the alleviation or abrogation of the cancer. This means that the life expectancy of an individual affected with the cancer will be increased or that one or more of the symptoms of the cancer will be reduced or ameliorated. The term encompasses a reduction in cancerous cell growth or tumor volume. Whether a mammal responds therapeutically can be measured by many methods well known in the art, such as PET imaging.

The amount of increase in the level of the at least one biomarker measured in the practice of the invention can be readily determined by one skilled in the art. In one aspect, the increase in the level of a biomarker is at least a two-fold difference, at least a three-fold difference, or at least a four-fold difference in the level of the biomarker.

The mammal can be, for example, a human, rat, mouse, dog, rabbit, pig sheep, cow, horse, cat, primate, or monkey.

The method of the invention can be, for example, an in vitro method wherein the step of measuring in the mammal the level of at least one biomarker comprises taking a biological sample from the mammal and then measuring the level of the biomarker(s) in the biological sample. The biological sample can comprise, for example, at least one of whole fresh blood, peripheral blood mononuclear cells, frozen whole blood, fresh plasma, frozen plasma, urine, saliva, skin, hair follicle, bone marrow, or tumor tissue.

The level of the at least one biomarker can be, for example, the level of protein and/or mRNA transcript of the biomarker(s).

The invention also provides an isolated biomarker selected from the biomarkers of Table 1 and Table 2. The biomarkers of the invention comprise sequences selected from the nucleotide and amino acid sequences provided in Table 1 and Table 2 and the Sequence Listing, as well as fragments and variants thereof.

The invention also provides a biomarker set comprising two or more biomarkers selected from the biomarkers of Table 1 and Table 2.

The invention also provides kits for determining or predicting whether a patient would be susceptible or resistant to a treatment that comprises one or more microtubule-stabilizing agents. The patient may have a cancer or tumor such as, for example, a breast cancer or tumor.

In one aspect, the kit comprises a suitable container that comprises one or more specialized microarrays of the invention, one or more microtubule-stabilizing agents for use in testing cells from patient tissue specimens or patient samples, and instructions for use. The kit may further comprise reagents or materials for monitoring the expression of a biomarker set at the level of mRNA or protein.

In another aspect, the invention provides a kit comprising two or more biomarkers selected from the biomarkers of Table 1 and Table 2.

In yet another aspect, the invention provides a kit comprising at least one of an antibody and a nucleic acid for detecting the presence of at least one of the biomarkers selected from the biomarkers of Table 1 and Table 2. In one aspect, the kit further comprises instructions for determining whether or not a mammal will respond therapeutically to a method of treating cancer comprising administering a microtubule-stabilizing agent. In another aspect, the instructions comprise the steps of (a) measuring in the mammal the level of at least one biomarker selected from the biomarkers of Table 1 and Table 2, (b) exposing the mammal to the microtubule-stabilizing agent, (c) following the exposing of step (b), measuring in the mammal the level of the at least one biomarker, wherein a difference in the level of the at least one biomarker measured in step (c) compared to the level of the at least one biomarker measured in step (a) predicts that the mammal will respond therapeutically to said method of treating cancer when said biomarker is from Table 1, and predicts that the mammal will not respond therapeutically to said method of treating cancer when said biomarker is from Table 2.

The invention also provides screening assays for determining if a patient will be susceptible or resistant to treatment with one or more microtubule-stabilizing agents.

The invention also provides a method of monitoring the treatment of a patient having a disease, wherein said disease is treated by a method comprising administering one or more microtubule-stabilizing agents.

The invention also provides individualized genetic profiles which are necessary to treat diseases and disorders based on patient response at a molecular level.

The invention also provides specialized microarrays, e.g., oligonucleotide microarrays or cDNA microarrays, comprising one or more biomarkers having expression profiles that correlate with either sensitivity or resistance to one or more microtubule-stabilizing agents.

The invention also provides antibodies, including polyclonal or monoclonal, directed against one or more biomarkers of the invention.

The invention will be better understood upon a reading of the detailed description of the invention when considered in connection with the accompanying figures.

BRIEF DESCRIPTION OF THE FIGURES

The patent or application file contains at least one drawing executed in color. Copies of this patent or patent application publication with color drawing(s) will be provided by the Office upon request and payment of the necessary fee.

As shown in FIG. 2, error rates for classifiers (8-250 genes) remain to be the minimum at zero.

Figure 8:
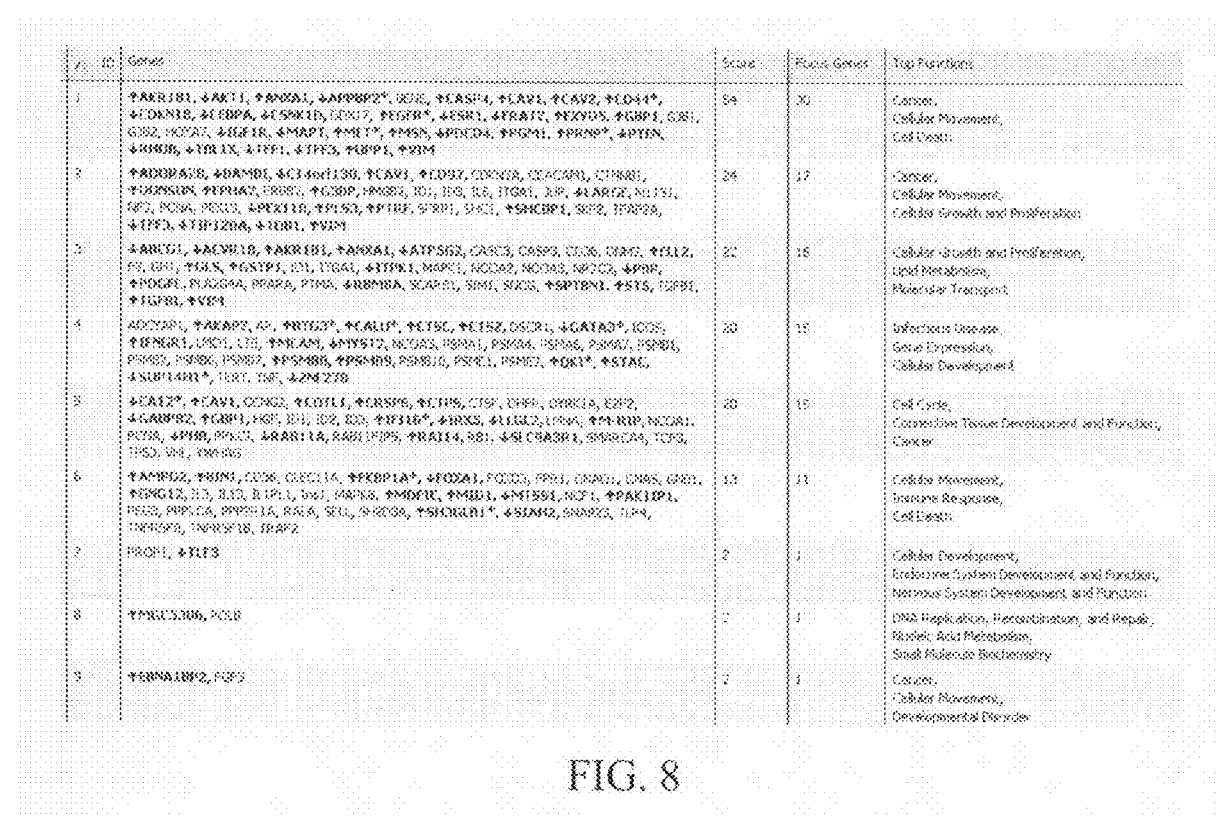

FIG. 8 illustrates the biological networks implied in the mechanism of resistance to ixabepilone as determined by Ingenuity® pathway analysis using 200 preclinical candidate markers. There are nine major networks indicated above with their significance scores. As shown, ER pathway is the most implicated network.

DETAILED DESCRIPTION OF THE INVENTION

Figure 1:
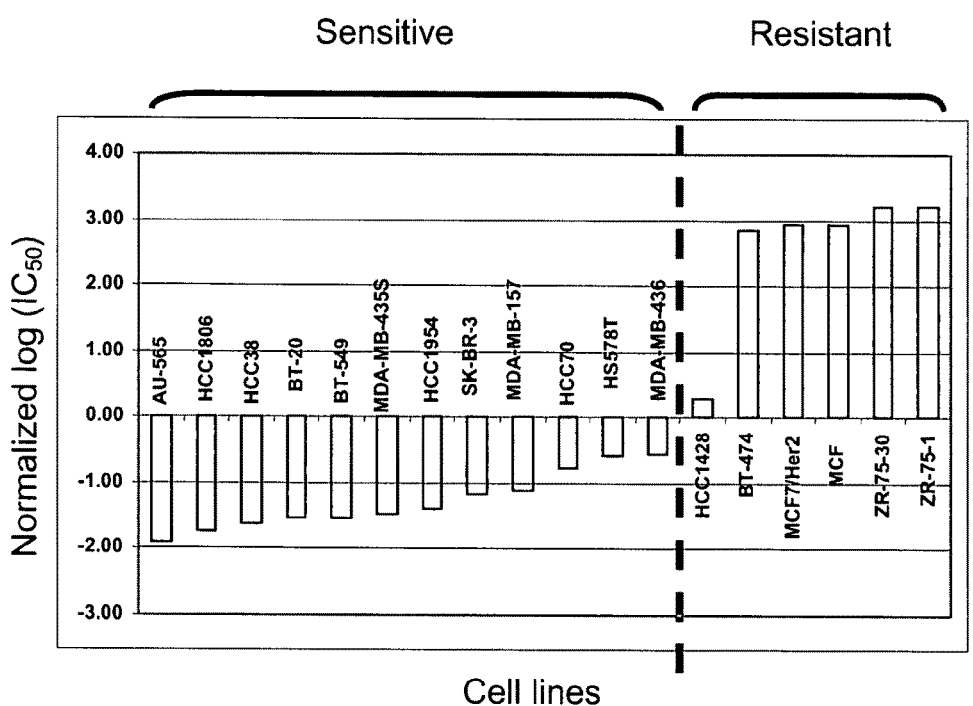
FIG. 1 illustrates classification of breast cancer cell lines based on $IC_{50}$ values measured against ixabepilone treatment. The cell lines were normalized based on a mean of the log ($IC_{50}$) values (a dotted line) and divided into two groups defined as sensitive or resistant. The cell lines on the left are defined as sensitive since they are below the mean of the log($IC_{50}$)s, and those on the right are defined as resistant since they are above the mean.

The invention provides biomarkers that correlate with microtubule-stabilization agent sensitivity or resistance. These biomarkers can be employed for predicting response to one or more microtubule-stabilization agents. In one aspect, the biomarkers of the invention are those provided in Table 1, Table 2, and the Sequence Listing, including both polynucleotide and polypeptide sequences.

The biomarkers provided in Table 1 include the nucleotide sequences of SEQ ID NOS:1-100 and the amino acid sequences of SEQ ID NOS:201-299.

TABLE 1

| BIOMARKERS (SENSITIVE) | | | |
|---|---|---|---|
| Unigene title and SEQ ID NO: | Affymetrix Description | Affymetrix Probe Set | Gene Ontology |
| C6orf145: chromosome 6 open reading frame 145 (LOC221749) SEQ ID NOS: 1 (DNA) and 201 (amino acid) | "Consensus includes gb: AK024828.1 /DEF = *Homo sapiens* cDNA: FLJ21175 fis, clone CAS11071. /FEA = mRNA /DB_XREF = gi: 10437233 /UG = Hs.69388 hypothetical protein FLJ20505" | 212923_s_at | |
| RTCD1: RNA terminal phosphate cyclase domain 1 (LOC8634) SEQ ID NOS: 2 (DNA) and 202 (amino acid) | "gb: NM_003729.1 /DEF = *Homo sapiens* RNA 3-terminal phosphate cyclase (RPC), mRNA. /FEA = mRNA /GEN = RPC /PROD = RNA 3-terminal phosphate cyclase /DB_XREF = gi: 4506588 /UG = Hs.27076 RNA 3-terminal phosphate cyclase /FL = gb: NM_003729.1" | 203594_at | assembly of spliceosomal tri- snRNP |
| FXYD5: FXYD domain containing ion transport regulator 5 (LOC53827) SEQ ID NOS: 3 | "gb: NM_014164.2 /DEF = *Homo sapiens* FXYD domain-containing ion transport regulator 5 (FXYD5), mRNA. /FEA = mRNA /GEN = FXYD5 /PROD = related to ion channel /DB_XREF = gi: 11612664 | 218084_x_at | negative regulation of calcium- dependent cell-cell |

TABLE 1-continued

BIOMARKERS (SENSITIVE)

| Unigene title and SEQ ID NO: | Affymetrix Description | Affymetrix Probe Set | Gene Ontology |
|---|---|---|---|
| (DNA) and 203 (amino acid) | /UG = Hs.294135 FXYD domain-containing ion transport regulator 5 /FL = gb: NM_014164.2 gb: AF161462.1" | | adhesion |
| G3BP: Ras-GTPase-activating protein SH3-domain-binding protein (LOC10146) SEQ ID NOS: 4 (DNA) and 204 (amino acid) | Consensus includes gb: BG500067 /FEA = EST /DB_XREF = gi: 13461584 /DB_XREF = est: 602545874F1 /CLONE = IMAGE: 4668234 /UG = Hs.220689 Ras-GTPase-activating protein SH3-domain-binding protein /FL = gb: U32519.1 gb: NM_005754.1 | 201503_at | protein-nucleus import |
| FKBP1A: FK506 binding protein 1A, 12 kDa (LOC2280) SEQ ID NOS: 5 (DNA) and 205 (amino acid) | "gb: NM_000801.1 /DEF = *Homo sapiens* FK506-binding protein 1A (12 kD) (FKBP1A), mRNA. /FEA = mRNA /GEN = FKBP1A /PROD = FK506-binding protein 1A (12 kD) /DB_XREF = gi: 4503724 /UG = Hs.752 FK506-binding protein 1A (12 kD) /FL = gb: BC001925.1 gb: M34539.1 gb: NM_000801.1" | 200709_at | protein folding |
| VARS2: valyl-tRNA synthetase 2 (LOC7407) SEQ ID NOS: 6 (DNA) and 206 (amino acid) | "gb: NM_006295.1 /DEF = *Homo sapiens* valyl-tRNA synthetase 2 (VARS2), mRNA. /FEA = mRNA /GEN = VARS2 /PROD = valyl-tRNA synthetase 2 /DB_XREF = gi: 5454157 /UG = Hs.159637 valyl-tRNA synthetase 2 /FL = gb: NM_006295.1" | 201797_s_at | translational elongation |
| FKBP1A: FK506 binding protein 1A, 12 kDa (LOC2280) SEQ ID NOS: 7 (DNA) and 207 (amino acid) | Consensus includes gb: AI936769 /FEA = EST /DB_XREF = gi: 5675639 /DB_XREF = est: wp69c11.x1 /CLONE = IMAGE: 2467028 /UG = Hs.752 FK506-binding protein 1A (12 kD) | 214119_s_at | protein folding |
| MTMR2: myotubularin related protein 2 (LOC8898) SEQ ID NOS: 8 (DNA) and 208 (amino acid) | "Consensus includes gb: AK027038.1 /DEF = *Homo sapiens* cDNA: FLJ23385 fis, clone HEP16802. /FEA = mRNA /DB_XREF = gi: 10440053 /UG = Hs.181326 KIAA1073 protein /FL = gb: AB028996.1 gb: NM_016156.1" | 203211_s_at | protein amino acid dephosphorylation |
| PSMB8: proteasome (prosome, macropain) subunit, beta type, 8 (large multifunctional protease 7) (LOC5696) SEQ ID NOS: 9 (DNA) and 209 (amino acid) | "gb: U17496.1 /DEF = Human proteasome subunit LMP7 (allele LMP7B) mRNA, complete cds. /FEA = mRNA /GEN = LMP7 /PROD = proteasome subunit LMP7 /DB_XREF = gi: 596139 /UG = Hs.180062 proteasome (prosome, macropain) subunit, beta type, 8 (large multifunctional protease 7) /FL = gb: U17496.1 gb: U17497.1" | 209040_s_at | proteolysis and peptidolysis, ubiquitin-dependent protein catabolism |
| CTSC: cathepsin C (LOC1075) SEQ ID NOS: 10 (DNA) and 210 (amino acid) | "gb: NM_001814.1 /DEF = *Homo sapiens* cathepsin C (CTSC), mRNA. /FEA = mRNA /GEN = CTSC /PROD = cathepsin C /DB_XREF = gi: 4503140 /UG = Hs.10029 cathepsin C /FL = gb: NM_001814.1" | 201487_at | proteolysis and peptidolysis |
| ST5: suppression of tumorigenicity 5 (LOC6764) SEQ ID NOS: 11 (DNA) and 211 (amino acid) | "gb: NM_005418.1 /DEF = *Homo sapiens* suppression of tumorigenicity 5 (ST5), mRNA. /FEA = mRNA /GEN = ST5 /PROD = suppression of tumorigenicity 5 /DB_XREF = gi: 4885612 /UG = Hs.79265 suppression of tumorigenicity 5 /FL = gb: U15131.1 gb: U15779.1 gb: NM_005418.1" | 202440_s_at | |
| MTMR2: myotubularin related protein 2 (LOC8898) SEQ ID NOS: 12 (DNA) and 212 | "Consensus includes gb: U58033.1 /DEF = *Homo sapiens* myotubularin related protein 2 (MTMR2) mRNA, partial cds. /FEA = mRNA /GEN = MTMR2 /PROD = myotubularin related protein 2 /DB_XREF = gi: 3912941 | 214649_s_at | protein amino acid dephosphorylation |

TABLE 1-continued

BIOMARKERS (SENSITIVE)

| Unigene title and SEQ ID NO: | Affymetrix Description | Affymetrix Probe Set | Gene Ontology |
|---|---|---|---|
| (amino acid) | /UG = Hs.278491 myotubularin related protein 2 /FL = gb: NM_003912.1" | | |
| PRNP: prion protein (p27-30) (Creutzfeld-Jakob disease, Gerstmann-Strausler-Scheinker syndrome, fatal familial insomnia) (LOC5621) SEQ ID NOS: 13 (DNA) and 213 (amino acid) | "gb: NM_000311.1 /DEF = Homo sapiens prion protein (p27-30) (Creutzfeld-Jakob disease, Gerstmann-Strausler-Scheinker syndrome, fatal familial insomnia) (PRNP), mRNA. /FEA = mRNA /GEN = PRNP /PROD = prion protein /DB_XREF = gi: 4506112 /UG = Hs.74621 prion protein (p27-30) (Creutzfeld-Jakob disease, Gerstmann-Strausler-Scheinker syndrome, fatal familial insomnia) /FL = gb: AY008282.1 gb: M13899.1 gb: NM_000311.1" | 201300_s_at | |
| MET: met proto-oncogene (hepatocyte growth factor receptor) (LOC4233) SEQ ID NOS: 14 (DNA) and 214 (amino acid) | "gb: U19348.1 /DEF = Human (tpr-met fusion) oncogene mRNA, complete cds. /FEA = mRNA /GEN = tprmet fusion /PROD = tpr-met fusion protein /DB_XREF = gi: 625085 /FL = gb: U19348.1" | 211599_x_at | signal transduction |
| MIRAB13: molecule interacting with Rab13 (LOC85377) SEQ ID NOS: 15 (DNA) and 215 (amino acid) | "Cluster Incl. W46406: zc31c10.s1 Homo sapiens cDNA, 3 end /clone = IMAGE-323922 /clone_end = 3' /gb = W46406 /gi = 1331036 /ug = Hs.8535 /len = 568" | 55081_at | vesicle-mediated transport |
| AKAP2: A kinase (PRKA) anchor protein 2 (LOC11217) SEQ ID NOS: 16 (DNA) and 216 (amino acid) | Consensus includes gb: BE879367 /FEA = EST /DB_XREF = gi: 10328143 /DB_XREF = est: 601484628F1 /CLONE = IMAGE: 3887262 /UG = Hs.42322 A kinase (PRKA) anchor protein 2 /FL = gb: AB023137.1 gb: NM_007203.1 | 202759_s_at | |
| MET: met proto-oncogene (hepatocyte growth factor receptor) (LOC4233) SEQ ID NOS: 17 (DNA) and 217 (amino acid) | Consensus includes gb: BG170541 /FEA = EST /DB_XREF = gi: 12677244 /DB_XREF = est: 602322942F1 /CLONE = IMAGE: 4425947 /UG = Hs.285754 met proto-oncogene (hepatocyte growth factor receptor) /FL = gb: J02958.1 gb: NM_000245.1 | 203510_at | signal transduction |
| STAC: SH3 and cysteine rich domain (LOC6769) SEQ ID NOS: 18 (DNA) and 218 (amino acid) | "gb: NM_003149.1 /DEF = Homo sapiens src homology three (SH3) and cysteine rich domain (STAC), mRNA. /FEA = mRNA /GEN = STAC /PROD = src homology three (SH3) and cysteine richdomain /DB_XREF = gi: 4507246 /UG = Hs.56045 src homology three (SH3) and cysteine rich domain /FL = gb: D86640.1 gb: NM_003149.1" | 205743_at | intracellular signaling cascade |
| CALU: calumenin (LOC813) SEQ ID NOS: 19 (DNA) and 219 (amino acid) | Consensus includes gb: BF939365 /FEA = EST /DB_XREF = gi: 12356685 /DB_XREF = est: nad87h04.x1 /CLONE = IMAGE: 3410551 /UG = Hs.7753 calumenin /FL = gb: U67280.1 gb: AF013759.1 gb: NM_001219.2 | 200755_s_at | |
| MSN: moesin (LOC4478) SEQ ID NOS: 20 (DNA) and 220 (amino acid) | "gb: NM_002444.1 /DEF = Homo sapiens moesin (MSN), mRNA. /FEA = mRNA /GEN = MSN /PROD = moesin /DB_XREF = gi: 4505256 /UG = Hs.170328 moesin /FL = gb: M69066.1 gb: NM_002444.1" | 200600_at | cell motility |
| ANXA1: annexin A1 (LOC301) SEQ ID NOS: 21 (DNA) and 221 | "gb: NM_000700.1 /DEF = Homo sapiens annexin A1 (ANXA1), mRNA. /FEA = mRNA /GEN = ANXA1 /PROD = annexin I | 201012_at | inflammatory response, cell motility |

TABLE 1-continued

BIOMARKERS (SENSITIVE)

| Unigene title and SEQ ID NO: | Affymetrix Description | Affymetrix Probe Set | Gene Ontology |
|---|---|---|---|
| (amino acid) | /DB_XREF = gi: 4502100 /UG = Hs.78225 annexin A1 /FL = gb: BC001275.1 gb: NM_000700.1" | | |
| CGI-100: CGI-100 protein (LOC50999) SEQ ID NOS: 22 (DNA) and 222 (amino acid) | "gb: NM_016040.1 /DEF = Homo sapiens CGI-100 protein (LOC50999), mRNA. /FEA = mRNA /GEN = LOC50999 /PROD = CGI-100 protein /DB_XREF = gi: 7705583 /UG = Hs.296155 CGI-100 protein /FL = gb: AF151858.1 gb: NM_016040.1" | 202195_s_at | intracellular protein transport |
| CALU: calumenin (LOC813) SEQ ID NOS: 23 (DNA) and 223 (amino acid) | "gb: NM_001219.2 /DEF = Homo sapiens calumenin (CALU), mRNA. /FEA = mRNA /GEN = CALU /PROD = calumenin precursor /DB_XREF = gi: 6005991 /UG = Hs.7753 calumenin /FL = gb: U67280.1 gb: AF013759.1 gb: NM_001219.2" | 200757_s_at | |
| EGFR: epidermal growth factor receptor (erythroblastic leukemia viral (v-erb-b) oncogene homolog, avian) (LOC1956) SEQ ID NOS: 24 (DNA) and 224 (amino acid) | "gb: U95089.1 /DEF = Human truncated epidermal growth factor receptor-like protein precursor mRNA, complete cds. /FEA = mRNA /PROD = truncated epidermal growth factor receptor-likeprotein precursor /DB_XREF = gi: 2051984 /UG = Hs.77432 epidermal growth factor receptor (avian erythroblastic leukemia viral (v-erb-b) oncogene homolog) /FL = gb: U95089.1" | 210984_x_at | EGF receptor signaling pathway |
| CASP4: caspase 4, apoptosis-related cysteine protease (LOC837) SEQ ID NOS: 25 (DNA) and 225 (amino acid) | "gb: U25804.1 /DEF = Human Ich-2 cysteine protease mRNA, complete cds. /FEA = mRNA /PROD = Ich-2 /DB_XREF = gi: 886049 /UG = Hs.74122 caspase 4, apoptosis-related cysteine protease /FL = gb: U28976.1 gb: U28977.1 gb: U28978.1 gb: NM_001225.1 gb: U25804.1 gb: U28014.1" | 209310_s_at | apoptosis |
| DKFZP566E144: small fragment nuclease (LOC25996) SEQ ID NOS: 26 (DNA) and 226 (amino acid) | "gb: NM_015523.1 /DEF = Homo sapiens small fragment nuclease (DKFZP566E144), mRNA. /FEA = mRNA /GEN = DKFZP566E144 /PROD = small fragment nuclease /DB_XREF = gi: 7661645 /UG = Hs.7527 small fragment nuclease /FL = gb: AF151872.1 gb: AL110239.1 gb: NM_015523.1" | 218194_at | nucleotide metabolism |
| AKR1B1: aldo-keto reductase family 1, member B1 (aldose reductase) (LOC231) SEQ ID NOS: 27 (DNA) and 227 (amino acid) | "gb: NM_001628.1 /DEF = Homo sapiens aldo-keto reductase family 1, member B1 (aldose reductase) (AKR1B1), mRNA. /FEA = mRNA /GEN = AKR1B1 /PROD = aldo-keto reductase family 1, member B1 (aldosereductase) /DB_XREF = gi: 4502048 /UG = Hs.75313 aldo-keto reductase family 1, member B1 (aldose reductase) /FL = gb: BC000260.1 gb: BC005387.1 gb: J04795.1 gb: J05017.1 gb: J05474.1 gb: M34720.1 gb: NM_001628.1" | 201272_at | carbohydrate metabolism |
| CAV1: caveolin 1, caveolae protein, 22 kDa (LOC857) SEQ ID NOS: 28 (DNA) and 228 (amino acid) | Consensus includes gb: AU147399 /FEA = EST /DB_XREF = gi: 11008920 /DB_XREF = est: AU147399 /CLONE = MAMMA1000563 /UG = Hs.74034 Homo sapiens clone 24651 mRNA sequence | 212097_at | |
| MBNL2: muscleblind-like 2 (Drosophila) (LOC10150) SEQ ID NOS: 29 (DNA) and 229 (amino acid) | Consensus includes gb: BE328496 /FEA = EST /DB_XREF = gi: 9202272 /DB_XREF = est: hs98f09.x1 /CLONE = IMAGE: 3145289 /UG = Hs.283609 hypothetical protein PRO2032 /FL = gb: AF116683.1 gb: NM_018615.1 | 203640_at | |
| CRSP6: cofactor required for Sp1 transcriptional activation, subunit | "gb: AF105421.1 /DEF = Homo sapiens vitamin D3 receptor interacting protein (DRIP80) mRNA, complete cds. /FEA = mRNA /GEN = DRIP80 | 221517_s_at | regulation of transcription, DNA- |

TABLE 1-continued

BIOMARKERS (SENSITIVE)

| Unigene title and SEQ ID NO: | Affymetrix Description | Affymetrix Probe Set | Gene Ontology |
|---|---|---|---|
| 6, 77 kDa (LOC9440) SEQ ID NOS: 30 (DNA) and 230 (amino acid) | /PROD = vitamin D3 receptor interacting protein /DB_XREF = gi: 4838128 /UG = Hs.22630 cofactor required for Sp1 transcriptional activation, subunit 6 (77 kD) /FL = gb: AF105421.1" | | dependent |
| CALU: calumenin (LOC813) SEQ ID NOS: 31 (DNA) and 231 (amino acid) | "gb: U67280.1 /DEF = *Homo sapiens* calumenin mRNA, complete cds. /FEA = mRNA /PROD = calumenin /DB_XREF = gi: 2809323 /UG = Hs.7753 calumenin /FL = gb: U67280.1 gb: AF013759.1 gb: NM_001219.2" | 200756_x_at | |
| PTRF: polymerase I and transcript release factor (LOC284119) SEQ ID NOS: 32 (DNA) and 232 (amino acid) | "Consensus includes gb: BC004295.1 /DEF = *Homo sapiens*, clone IMAGE: 3622356, mRNA, partial cds. /FEA = mRNA /PROD = Unknown (protein for IMAGE: 3622356) /DB_XREF = gi: 13279151 /UG = Hs.29759 RNA POLYMERASE I AND TRANSCRIPT RELEASE FACTOR /FL = gb: AF312393.1" | 208789_at | |
| NUP155: nucleoporin 155 kDa (LOC9631) SEQ ID NOS: 33 (DNA) and 233 (amino acid) | "gb: NM_004298.1 /DEF = *Homo sapiens* nucleoporin 155 kD (NUP155), mRNA. /FEA = mRNA /GEN = NUP155 /PROD = nucleoporin 155 kD /DB_XREF = gi: 4758843 /UG = Hs.23255 nucleoporin 155 kD /FL = gb: AB018334.1 gb: NM_004298.1" | 206550_s_at | nucleocytoplasmic transport |
| DONSON: downstream neighbor of SON (LOC29980) SEQ ID NOS: 34 (DNA) and 234 (amino acid) | "gb: AF232674.1 /DEF = *Homo sapiens* B17 mRNA, complete cds. /FEA = mRNA /PROD = B17 /DB_XREF = gi: 8118230 /UG = Hs.17834 downstream neighbor of SON /FL = gb: AF232674.1" | 221677_s_at | |
| CALU: calumenin (LOC813) SEQ ID NOS: 35 (DNA) and 235 (amino acid) | "Consensus includes gb: AF257659.1 /DEF = *Homo sapiens* crocalbin-like protein mRNA, partial cds. /FEA = mRNA /PROD = crocalbin-like protein /DB_XREF = gi: 8515717 /UG = Hs.302073 *Homo sapiens* crocalbin-like protein mRNA, partial cds" | 214845_s_at | |
| FAD104: FAD104 (LOC64778) SEQ ID NOS: 36 (DNA) and 236 (amino acid) | "gb: NM_022763.1 /DEF = *Homo sapiens* hypothetical protein FLJ23399 (FLJ23399), mRNA. /FEA = mRNA /GEN = FLJ23399 /PROD = hypothetical protein FLJ23399 /DB_XREF = gi: 12232434 /UG = Hs.299883 hypothetical protein FLJ23399 /FL = gb: NM_022763.1" | 218618_s_at | |
| EPHA2: EphA2 (LOC1969) SEQ ID NOS: 37 (DNA) and 237 (amino acid) | "gb: NM_004431.1 /DEF = *Homo sapiens* EphA2 (EPHA2), mRNA. /FEA = mRNA /GEN = EPHA2 /PROD = EphA2 /DB_XREF = gi: 4758277 /UG = Hs.171596 EphA2 /FL = gb: M59371.1 gb: NM_004431.1" | 203499_at | |
| PAK1IP1: PAK1 interacting protein 1 (LOC55003) SEQ ID NOS: 38 (DNA) and 238 (amino acid) | "gb: NM_017906.1 /DEF = *Homo sapiens* hypothetical protein FLJ20624 (FLJ20624), mRNA. /FEA = mRNA /GEN = FLJ20624 /PROD = hypothetical protein FLJ20624 /DB_XREF = gi: 8923576 /UG = Hs.52256 hypothetical protein FLJ20624 /FL = gb: NM_017906.1" | 218886_at | |
| CTPS: CTP synthase (LOC1503) SEQ ID NOS: 39 (DNA) and 239 (amino acid) | "gb: NM_001905.1 /DEF = *Homo sapiens* CTP synthase (CTPS), mRNA. /FEA = mRNA /GEN = CTPS /PROD = CTP synthase /DB_XREF = gi: 4503132 /UG = Hs.251871 CTP synthase /FL = gb: NM_001905.1" | 202613_at | pyrimidine nucleotide biosynthesis |
| CD44: CD44 antigen (homing function and | "gb: BC004372.1 /DEF = *Homo sapiens*, Similar to CD44 antigen (homing function and Indian blood group system), | 209835_x_at | cell-cell adhesion |

TABLE 1-continued

BIOMARKERS (SENSITIVE)

| Unigene title and SEQ ID NO: | Affymetrix Description | Affymetrix Probe Set | Gene Ontology |
|---|---|---|---|
| Indian blood group system) (LOC960) SEQ ID NOS: 40 (DNA) and 240 (amino acid) | clone MGC: 10468, mRNA, complete cds. /FEA = mRNA /PROD = Similar to CD44 antigen (homing function and Indian blood group system) /DB_XREF = gi: 13325117 /UG = Hs.169610 CD44 antigen (homing function and Indian blood group system) /FL = gb: BC004372.1" | | |
| CD97: CD97 antigen (LOC976) SEQ ID NOS: 41 (DNA) and 241 (amino acid) | "gb: NM_001784.1 /DEF = *Homo sapiens* CD97 antigen (CD97), mRNA. /FEA = mRNA /GEN = CD97 /PROD = CD97 antigen /DB_XREF = gi: 4502690./UG = Hs.3107 CD97 antigen /FL = gb: NM_001784.1" | 202910_s_at | G-protein coupled receptor protein signaling pathway |
| SPTBN1: spectrin, beta, non-erythrocytic 1 (LOC6711) SEQ ID NOS: 42 (DNA) and 242 (amino acid) | "Consensus includes gb: BE968833 /FEA = EST /DB_XREF = gi: 10579538 /DB_XREF = est: 601649861F1 /CLONE = IMAGE: 3933782 /UG = Hs.324648 *Homo sapiens* cDNA FLJ13700 fis, clone PLACE2000216, highly similar to SPECTRIN BETA CHAIN, BRAIN" | 212071_s_at | |
| SH3GLB1: SH3-domain GRB2-like endophilin B1 (LOC51100) SEQ ID NOS: 43 (DNA) and 243 (amino acid) | "gb: AF263293.1 /DEF = *Homo sapiens* endophilin B1 mRNA, complete cds. /FEA = mRNA /PROD = endophilin B1 /DB_XREF = gi: 8118529 /UG = Hs.136309 SH3-containing protein SH3GLB1 /FL = gb: AF263293.1" | 209091_s_at | |
| PGM1: phosphoglucomutase 1 (LOC5236) SEQ ID NOS: 44 (DNA) and 244 (amino acid) | "gb: NM_002633.1 /DEF = *Homo sapiens* phosphoglucomutase 1 (PGM1), mRNA. /FEA = mRNA /GEN = PGM1 /PROD = phosphoglucomutase 1 /DB_XREF = gi: 4505764 /UG = Hs.1869 phosphoglucomutase 1 /FL = gb: BC001756.1 gb: M83088.1 gb: NM_002633.1" | 201968_s_at | glucose metabolism |
| SH3GLB1: SH3-domain GRB2-like endophilin B1 (LOC51100) SEQ ID NOS: 45 (DNA) and 245 (amino acid) | "gb: AF257318.1 /DEF = *Homo sapiens* SH3-containing protein SH3GLB1 mRNA, complete cds. /FEA = mRNA /PROD = SH3-containing protein SH3GLB1 /DB_XREF = gi: 8896091 /UG = Hs.136309 SH3-containing protein SH3GLB1 /FL = gb: AF350371.1 gb: AF151819.1 gb: NM_016009.1 gb: AF257318.1" | 210101_x_at | |
| GBP1: guanylate binding protein 1, interferon-inducible, 67 kDa (LOC2633) SEQ ID NOS: 46 (DNA) and 246 (amino acid) | "gb: BC002666.1 /DEF = *Homo sapiens*, guanylate binding protein 1, interferon-inducible, 67 kD, clone MGC: 3949, mRNA, complete cds. /FEA = mRNA /PROD = guanylate binding protein 1, interferon-inducible, 67 kD /DB_XREF = gi: 12803662 /UG = Hs.62661 guanylate binding protein 1, interferon-inducible, 67 kD /FL = gb: BC002666.1 gb: M55542.1 gb: NM_002053.1" | 202269_x_at | immune response |
| ADORA2B: adenosine A2b receptor (LOC136) SEQ ID NOS: 47 (DNA) and 247 (amino acid) | "gb: NM_000676.1 /DEF = *Homo sapiens* adenosine A2b receptor (ADORA2B), mRNA. /FEA = mRNA /GEN = ADORA2B /PROD = adenosine A2b receptor /DB_XREF = gi: 4501950 /UG = Hs.45743 adenosine A2b receptor /FL = gb: M97759.1 gb: NM_000676.1" | 205891_at | adenylate cyclase activation |
| PLS3: plastin 3 (T isoform) (LOC5358) SEQ ID NOS: 48 (DNA) and 248 (amino acid) | "gb: NM_005032.2 /DEF = *Homo sapiens* plastin 3 (T isoform) (PLS3), mRNA. /FEA = mRNA /GEN = PLS3 /PROD = plastin 3 precursor /DB_XREF = gi: 7549808 /UG = Hs.4114 plastin 3 (T isoform) /FL = gb: M22299.1 gb: NM_005032.2" | 201215_at | |
| PDGFC: platelet derived growth factor C | "gb: NM_016205.1 /DEF = *Homo sapiens* platelet derived growth factor C (PDGFC), mRNA. /FEA = mRNA | 218718_at | |

TABLE 1-continued

BIOMARKERS (SENSITIVE)

| Unigene title and SEQ ID NO: | Affymetrix Description | Affymetrix Probe Set | Gene Ontology |
|---|---|---|---|
| (LOC56034) SEQ ID NOS: 49 (DNA) and 249 (amino acid) | /GEN = PDGFC /PROD = secretory growth factor-like protein fallotein /DB_XREF = gi: 9994186 /UG = Hs.43080 platelet derived growth factor C /FL = gb: AF091434.1 gb: AF244813.1 gb: AB033831.1 gb: NM_016205.1" | | |
| MID1: midline 1 (Opitz/BBB syndrome) (LOC4281) SEQ ID NOS: 50 (DNA) and 250 (amino acid) | "gb: NM_000381.1 /DEF = *Homo sapiens* midline 1 (OpitzBBB syndrome) (MID1), mRNA. /FEA = mRNA /GEN = MID1 /PROD = midline 1 /DB_XREF = gi: 4557752 /UG = Hs.27695 midline 1 (OpitzBBB syndrome) /FL = gb: AF269101.1 gb: AF230976.1 gb: AF035360.1 gb: NM_000381.1" | 203637_s_at | microtubule cytoskeleton organization and biogenesis |
| MET: met proto-oncogene (hepatocyte growth factor receptor) (LOC4233) SEQ ID NOS: 51 (DNA) and 251 (amino acid) | Consensus includes gb: BE870509 /FEA = EST /DB_XREF = gi: 10319285 /DB_XREF = est: 601447096F1 /CLONE = IMAGE: 3851374 /UG = Hs.285754 met proto-oncogene (hepatocyte growth factor receptor) | 213807_x_at | signal transduction |
| CHST6: carbohydrate (N-acetylglucosamine 6-O) sulfotransferase 6 (LOC4166) SEQ ID NOS: 52 (DNA) and 252 (amino acid) | "gb: NM_021615.1 /DEF = *Homo sapiens* carbohydrate (N-acetylglucosamine 6-O) sulfotransferase 6 (CHST6), mRNA. /FEA = mRNA /GEN = CHST6 /PROD = carbohydrate (N-acetylglucosamine 6-O)sulfotransferase 6 /DB_XREF = gi: 11055975 /UG = Hs.157439 carbohydrate (N-acetylglucosamine 6-O) sulfotransferase 6 /FL = gb: AF219990.1 gb: NM_021615.1" | 221059_s_at | proteoglycan sulfate transfer |
| MEIS2: Meis1, myeloid ecotropic viral integration site 1 homolog 2 (mouse) (LOC4212) SEQ ID NOS: 53 (DNA) and 253 (amino acid) | "gb: NM_020149.1 /DEF = *Homo sapiens* TALE homeobox protein Meis2e (LOC56908), mRNA. /FEA = mRNA /GEN = LOC56908 /PROD = TALE homeobox protein Meis2e /DB_XREF = gi: 9910355 /UG = Hs.283312 TALE homeobox protein Meis2e /FL = gb: AF179899.1 gb: NM_020149.1" | 207480_s_at | negative regulation of transcription from Pol II promoter |
| UPP1: uridine phosphorylase 1 (LOC7378) SEQ ID NOS: 54 (DNA) and 254 (amino acid) | "gb: NM_003364.1 /DEF = *Homo sapiens* uridine phosphorylase (UP), mRNA. /FEA = mRNA /GEN = UP /PROD = uridine phosphorylase /DB_XREF = gi: 4507838 /UG = Hs.77573 uridine phosphorylase /FL = gb: BC001405.1 gb: NM_003364.1" | 203234_at | nucleoside metabolism |
| CD44: CD44 antigen (homing function and Indian blood group system) (LOC960) SEQ ID NOS: 55 (DNA) and 255 (amino acid) | Consensus includes gb: AI493245 /FEA = EST /DB_XREF = gi: 4394248 /DB_XREF = est: ti30d08.x1 /CLONE = IMAGE: 2131983 /UG = Hs.169610 CD44 antigen (homing function and Indian blood group system) | 212014_x_at | cell-cell adhesion |
| BTG3: BTG family, member 3 (LOC10950) SEQ ID NOS: 56 (DNA) and 256 (amino acid) | "Consensus includes gb: AI765445 /FEA = EST /DB_XREF = gi: 5231954 /DB_XREF = est: wi80b08.x1 /CLONE = IMAGE: 2399607 /UG = Hs.77311 BTG family, member 3" | 213134_x_at | regulation of cell cycle |
| FKBP1A: FK506 binding protein 1A, 12 kDa (LOC2280) SEQ ID NOS: 57 (DNA) and 257 (amino acid) | "gb: BC005147.1 /DEF = *Homo sapiens*, FK506-binding protein 1A (12 kD), clone MGC: 2167, mRNA, complete cds. /FEA = mRNA /PROD = FK506-binding protein 1A (12 kD) /DB_XREF = gi: 13477342 /UG = Hs.752 FK506 binding protein 1A (12 kD) /FL = gb: BC005147.1" | 210186_s_at | protein folding |
| IFI16: interferon, gamma-inducible protein 16 | "gb: NM_005531.1 /DEF = *Homo sapiens* interferon, gamma-inducible protein 16 (IFI16), mRNA. /FEA = mRNA | 206332_s_at | |

TABLE 1-continued

BIOMARKERS (SENSITIVE)

| Unigene title and SEQ ID NO: | Affymetrix Description | Affymetrix Probe Set | Gene Ontology |
|---|---|---|---|
| (LOC3428) SEQ ID NOS: 58 (DNA) and 258 (amino acid) | /GEN = IFI16 /PROD = interferon, gamma-inducible protein 16 /DB_XREF = gi: 5031778 /UG = Hs.155530 interferon, gamma-inducible protein 16 /FL = gb: M63838.1 gb: NM_005531.1" | | |
| CD44: CD44 antigen (homing function and Indian blood group system) (LOC960) SEQ ID NOS: 59 (DNA) and 259 (amino acid) | Consensus includes gb: BE903880 /FEA = EST /DB_XREF = gi: 10395551 /DB_XREF = est: 601494678F1 /CLONE = IMAGE: 3896970 /UG = Hs.323950 zinc finger protein 6 (CMPX1) | 212063_at | cell-cell adhesion |
| IFI16: interferon, gamma-inducible protein 16 (LOC3428) SEQ ID NOS: 60 (DNA) and 260 (amino acid) | "gb: AF208043.1 /DEF = *Homo sapiens* IFI16b (IFI16b) mRNA, complete cds. /FEA = mRNA /GEN = IFI16b /PROD = IFI16b /DB_XREF = gi: 6644296 /UG = Hs.155530 interferon, gamma-inducible protein 16 /FL = gb: AF208043.1" | 208966_x_at | |
| GNG12: guanine nucleotide binding protein (G protein), gamma 12 (LOC55970) SEQ ID NOS: 61 (DNA) and 261 (amino acid) | Consensus includes gb: BG111761 /FEA = EST /DB_XREF = gi: 12605267 /DB_XREF = est: 602285343F1 /CLONE = IMAGE: 4372619 /UG = Hs.8107 *Homo sapiens* mRNA; cDNA DKFZp586B0918 (from clone DKFZp586B0918) | 212294_at | signal transduction |
| GSTP1: glutathione S-transferase pi (LOC2950) SEQ ID NOS: 62 (DNA) and 262 (amino acid) | "gb: NM_000852.2 /DEF = *Homo sapiens* glutathione S-transferase pi (GSTP1), mRNA. /FEA = mRNA /GEN = GSTP1 /PROD = glutathione transferase /DB_XREF = gi: 6552334 /UG = Hs.226795 glutathione S-transferase pi /FL = gb: U62589.1 gb: U30897.1 gb: NM_000852.2" | 200824_at | metabolism |
| MCAM: melanoma cell adhesion molecule (LOC4162) SEQ ID NOS: 63 (DNA) and 263 (amino acid) | "gb: BC006329.1 /DEF = *Homo sapiens*, Similar to melanoma adhesion molecule, clone MGC: 12808, mRNA, complete cds. /FEA = mRNA /PROD = Similar to melanoma adhesion molecule /DB_XREF = gi: 13623456 /FL = gb: BC006329.1" | 211042_x_at | |
| MIRAB13: molecule interacting with Rab13 (LOC85377) SEQ ID NOS: 64 (DNA) and 264 (amino acid) | "Consensus includes gb: BC001090.1 /DEF = *Homo sapiens*, clone IMAGE: 3504989, mRNA, partial cds. /FEA = mRNA /PROD = Unknown (protein for IMAGE: 3504989) /DB_XREF = gi: 12654518 /UG = Hs.8535 hypothetical protein bA395L14.2" | 221779_at | vesicle-mediated transport |
| IFI16: interferon, gamma-inducible protein 16 (LOC3428) SEQ ID NOS: 65 (DNA) and 265 (amino acid) | "Consensus includes gb: BG256677 /FEA = EST /DB_XREF = gi: 12766493 /DB_XREF = est: 602370865F1 /CLONE = IMAGE: 4478872 /UG = Hs.155530 interferon, gamma-inducible protein 16 /FL = gb: AF208043.1" | 208965_s_at | |
| DKFZp667G2110: hypothetical protein DKFZp667G2110 (LOC131544) SEQ ID NOS: 66 (DNA) | "Consensus includes gb: BE501352 /FEA = EST /DB_XREF = gi: 9703760 /DB_XREF = est: 7a41e05.x1 /CLONE = IMAGE: 3221312 /UG = Hs.23294 ESTs, Weakly similar to T15138 hypothetical protein T28F2.4-*Caenorhabditis elegans C. elegans*" | 214030_at | |
| C1GALT1: core 1 UDP-galactose:N-acetylgalactosamine-alpha-R beta 1,3-galactosyltransferase (LOC56913) SEQ ID NOS: 67 (DNA) and 266 | "gb: NM_020156.1 /DEF = *Homo sapiens* core1 UDP-galactose:N-acetylgalactosamine-alpha-R beta 1,3-galactosyltransferase (C1GALT1), mRNA. /FEA = mRNA /GEN = C1GALT1 /PROD = core1UDP-galactose:N-acetylgalactosamine-alpha-R beta1,3-galactosyltransferase | 219439_at | |

TABLE 1-continued

BIOMARKERS (SENSITIVE)

| Unigene title and SEQ ID NO: | Affymetrix Description | Affymetrix Probe Set | Gene Ontology |
|---|---|---|---|
| (amino acid) | /DB_XREF = gi: 9910143 /UG = Hs.46744 core1 UDP-galactose:N-acetylgalactosamine-alpha-R beta 1,3-galactosyltransferase /FL = gb: AF155582.1 gb: NM_020156.1" | | |
| RANGNRF: RAN guanine nucleotide release factor (LOC29098) SEQ ID NOS: 68 (DNA) and 267 (amino acid) | "gb: NM_014185.1 /DEF = *Homo sapiens* HSPC165 protein (HSPC165), mRNA. /FEA = mRNA /GEN = HSPC165 /PROD = HSPC165 protein /DB_XREF = gi: 7661825 /UG = Hs.13605 HSPC165 protein /FL = gb: AF161514.1 gb: AF151070.1 gb: NM_014185.1 gb: NM_016492.1 gb: AF168714.1 gb: AF265206.1" | 218526_s_at | |
| ELL2: elongation factor, RNA polymerase II, 2 (LOC22936) SEQ ID NOS: 69 (DNA) and 268 (amino acid) | "Consensus includes gb: NM_012081.1 /DEF = *Homo sapiens* ELL-RELATED RNA POLYMERASE II, ELONGATION FACTOR (ELL2), mRNA. /FEA = CDS /GEN = ELL2 /PROD = ELL-RELATED RNA POLYMERASE II, ELONGATIONFACTOR /DB_XREF = gi: 6912353 /UG = Hs.173334 ELL-RELATED RNA POLYMERASE II, ELONGATION FACTOR /FL = gb: NM_012081.1" | 214446_at | regulation of transcription, DNA-dependent |
| BIN1: bridging integrator 1 (LOC274) SEQ ID NOS: 70 (DNA) and 269 (amino acid) | "Consensus includes gb: AF043899.1 /DEF = *Homo sapiens* amphiphysin IIc1 mRNA, complete cds. /FEA = CDS /PROD = amphiphysin IIc1 /DB_XREF = gi: 3064256 /UG = Hs.193163 bridging integrator 1 /FL = gb: AF043899.1" | 214439_x_at | synaptic transmission |
| M-RIP: myosin phosphatase-Rho interacting protein (LOC23164) SEQ ID NOS: 71 (DNA) and 270 (amino acid) | "Consensus includes gb: AK025604.1 /DEF = *Homo sapiens* cDNA: FLJ21951 fis, clone HEP04968. /FEA = mRNA /DB_XREF = gi: 10438172 /UG = Hs.84883 KIAA0864 protein" | 214771_x_at | |
| MGC5306: hypothetical protein MGC5306 (LOC79101) SEQ ID NOS: 72 (DNA) and 271 (amino acid) | "gb: BC001972.1 /DEF = *Homo sapiens*, clone MGC: 5306, mRNA, complete cds. /FEA = mRNA /PROD = Unknown (protein for MGC: 5306) /DB_XREF = gi: 12805036 /UG = Hs.301732 hypothetical protein MGC5306 /FL = gb: BC001972.1" | 221580_s_at | |
| BTN3A3: butyrophilin, subfamily 3, member A3 (LOC10384) SEQ ID NOS: 73 (DNA) and 272 (amino acid) | "gb: NM_006994.2 /DEF = *Homo sapiens* butyrophilin, subfamily 3, member A3 (BTN3A3), mRNA. /FEA = mRNA /GEN = BTN3A3 /PROD = butyrophilin, subfamily 3, member A3 /DB_XREF = gi: 6325463 /UG = Hs.167741 butyrophilin, subfamily 3, member A3 /FL = gb: U90548.1 gb: NM_006994.2" | 204820_s_at | |
| CAV2: caveolin 2 (LOC858) SEQ ID NOS: 74 (DNA) and 273 (amino acid) | "gb: NM_001233.1 /DEF = *Homo sapiens* caveolin 2 (CAV2), mRNA. /FEA = mRNA /GEN = CAV2 /PROD = caveolin 2 /DB_XREF = gi: 4557412 /UG = Hs.139851 caveolin 2 /FL = gb: BC005256.1 gb: AF035752.1 gb: NM_001233.1" | 203324_s_at | |
| IFNGR1: interferon gamma receptor 1 (LOC3459) SEQ ID NOS: 75 (DNA) and 274 (amino acid) | "gb: NM_000416.1 /DEF = *Homo sapiens* interferon gamma receptor 1 (IFNGR1), mRNA. /FEA = mRNA /GEN = IFNGR1 /PROD = interferon gamma receptor 1 /DB_XREF = gi: 4557879 /UG = Hs.180866 interferon gamma receptor 1 /FL = gb: BC005333.1 gb: J03143.1 gb: NM_000416.1" | 202727_s_at | signal transduction |
| MGC5297: hypothetical | "gb: NM_024091.1 /DEF = *Homo sapiens* hypothetical protein MGC5297 | 219200_at | |

TABLE 1-continued

BIOMARKERS (SENSITIVE)

| Unigene title and SEQ ID NO: | Affymetrix Description | Affymetrix Probe Set | Gene Ontology |
|---|---|---|---|
| protein MGC5297 (LOC79072) SEQ ID NOS: 76 (DNA) and 275 (amino acid) | (MGC5297), mRNA. /FEA = mRNA /GEN = MGC5297 /PROD = hypothetical protein MGC5297 /DB_XREF = gi: 13129089 /UG = Hs.23856 hypothetical protein MGC5297 /FL = gb: BC001295.1 gb: NM_024091.1" | | |
| TGFBI: transforming growth factor, beta-induced, 68 kDa (LOC7045) SEQ ID NOS: 77 (DNA) and 276 (amino acid) | "gb: NM_000358.1 /DEF = *Homo sapiens* transforming growth factor, beta-induced, 68 kD (TGFBI), mRNA. /FEA = mRNA /GEN = TGFBI /PROD = transforming growth factor, beta-induced, 68 kD /DB_XREF = gi: 4507466 /UG = Hs.118787 transforming growth factor, beta-induced, 68 kD /FL = gb: BC000097.1 gb: BC004972.1 gb: M77349.1 gb: NM_000358.1" | 201506_at | cell adhesion |
| AKAP2: A kinase (PRKA) anchor protein 2 (LOC11217) SEQ ID NOS: 78 (DNA) and 277 (amino acid) | "gb: NM_007203.1 /DEF = *Homo sapiens* A kinase (PRKA) anchor protein 2 (AKAP2), mRNA. /FEA = mRNA /GEN = AKAP2 /PROD = A kinase (PRKA) anchor protein 2 /DB_XREF = gi: 6005708 /UG = Hs.42322 A kinase (PRKA) anchor protein 2 /FL = gb: AB023137.1 gb: NM_007203.1" | 202760_s_at | |
| QKI: quaking homolog, KH domain RNA binding (mouse) (LOC9444) SEQ ID NOS: 79 (DNA) and 278 (amino acid) | Consensus includes gb: AI114716 /FEA = EST /DB_XREF = gi: 6360061 /DB_XREF = est: HA1315 /UG = Hs.15020 homolog of mouse quaking QKI (KH domain RNA binding protein) /FL = gb: AF142419.1 gb: AF142422.1 | 212263_at | signal transduction |
| PRNP: prion protein (p27-30) (Creutzfeld-Jakob disease, Gerstmann-Strausler-Scheinker syndrome, fatal familial insomnia) (LOC5621) SEQ ID NOS: 80 (DNA) and 279 (amino acid) | "Consensus includes gb: AV725328 /FEA = EST /DB_XREF = gi: 10830606 /DB_XREF = est: AV725328 /CLONE = HTCAVD03 /UG = Hs.74621 prion protein (p27-30) (Creutzfeld-Jakob disease, Gerstmann-Strausler-Scheinker syndrome, fatal familial insomnia)" | 215707_s_at | |
| HIC: I-mfa domain-containing protein (LOC29969) SEQ ID NOS: 81 (DNA) and 280 (amino acid) | "gb: AF054589.1 /DEF = *Homo sapiens* HIC protein isoform p40 and HIC protein isoform p32 mRNAs, complete cds. /FEA = mRNA /PROD = HIC protein isoform p32; HIC protein isoform p40 /DB_XREF = gi: 3426297 /FL = gb: AF054589.1" | 211675_s_at | |
| POPDC3: popeye domain containing 3 (LOC64208) SEQ ID NOS: 82 (DNA) and 281 (amino acid) | "gb: NM_022361.1 /DEF = *Homo sapiens* popeye protein 3 (POP3), mRNA. /FEA = mRNA /GEN = POP3 /PROD = popeye protein 3 /DB_XREF = gi: 11641280 /UG = Hs.303154 popeye protein 3 /FL = gb: AF204171.1 gb: NM_022361.1" | 219926_at | |
| FLJ10315: hypothetical protein FLJ10315 (LOC55116) SEQ ID NOS: 83 (DNA) and 282 (amino acid) | "gb: NM_018056.1 /DEF = *Homo sapiens* hypothetical protein FLJ10315 (FLJ10315), mRNA. /FEA = mRNA /GEN = FLJ10315 /PROD = hypothetical protein FLJ10315 /DB_XREF = gi: 8922347 /UG = Hs.25544 hypothetical protein FLJ10315 /FL = gb: AL136695.1 gb: NM_018056.1" | 218770_s_at | |
| PSMB9: proteasome (prosome, macropain) subunit, beta type, | "gb: NM_002800.1 /DEF = *Homo sapiens* proteasome (prosome, macropain) subunit, beta type, 9 (large multifunctional protease 2) (PSMB9), mRNA. /FEA = mRNA /GEN = PSMB9 | 204279_at | proteolysis and peptidolysis, ubiquitin-dependent |

TABLE 1-continued

BIOMARKERS (SENSITIVE)

| Unigene title and SEQ ID NO: | Affymetrix Description | Affymetrix Probe Set | Gene Ontology |
|---|---|---|---|
| 9 (large multifunctional protease 2) (LOC5698) SEQ ID NOS: 84 (DNA) and 283 (amino acid) | /PROD = proteasome (prosome, macropain) subunit, betatype, 9 (large multifunctional protease 2) /DB_XREF = gi: 4506204 /UG = Hs.9280 proteasome (prosome, macropain) subunit, beta type, 9 (large multifunctional protease 2) /FL = gb: U01025.1 gb: NM_002800.1" | | protein catabolism |
| DEPDC1: DEP domain containing 1 (LOC55635) SEQ ID NOS: 85 (DNA) and 284 (amino acid) | "gb: NM_017779.1 /DEF = Homo sapiens hypothetical protein FLJ20354 (FLJ20354), mRNA. /FEA = mRNA /GEN = FLJ20354 /PROD = hypothetical protein FLJ20354 /DB_XREF = gi: 8923327 /UG = Hs.133260 hypothetical protein FLJ20354 /FL = gb: NM_017779.1" | 220295_x_at | |
| EGFR: epidermal growth factor receptor (erythroblastic leukemia viral (v-erb-b) oncogene homolog, avian) (LOC1956) SEQ ID NOS: 86 (DNA) and 285 (amino acid) | Consensus includes gb: AW157070 /FEA = EST /DB_XREF = gi: 6228471 /DB_XREF = est: au91e07.x1 /CLONE = IMAGE: 2783652 /UG = Hs.77432 epidermal growth factor receptor (avian erythroblastic leukemia viral (v-erb-b) oncogene homolog) /FL = gb: NM_005228.1 | 201983_s_at | EGF receptor signaling pathway |
| AMPD2: adenosine monophosphate deaminase 2 (isoform L) (LOC271) SEQ ID NOS: 87 (DNA) and 286 (amino acid) | Consensus includes gb: AI916249 /FEA = EST /DB_XREF = gi: 5636104 /DB_XREF = est: wg99c01.x1 /CLONE = IMAGE: 2379360 /UG = Hs.82927 adenosine monophosphate deaminase 2 (isoform L) /FL = gb: NM_004037.2 | 212360_at | purine nucleotide metabolism |
| GLS: glutaminase (LOC2744) SEQ ID NOS: 88 (DNA) and 287 (amino acid) | "gb: AF158555.1 /DEF = Homo sapiens glutaminase C mRNA, complete cds. /FEA = mRNA /PROD = glutaminase C /DB_XREF = gi: 5690371 /UG = Hs.239189 glutaminase /FL = gb: AF158555.1 gb: AF097492.1" | 221510_s_at | glutamine catabolism |
| EBNA1BP2: EBNA1 binding protein 2 (LOC10969) SEQ ID NOS: 89 (DNA) and 288 (amino acid) | "gb: NM_006824.1 /DEF = Homo sapiens nucleolar protein p40; homolog of yeast EBNA1-binding protein (P40), mRNA. /FEA = mRNA /GEN = P40 /PROD = nucleolar protein p40; homolog of yeastEBNA1-binding protein /DB_XREF = gi: 5803110 /UG = Hs.74407 nucleolar protein p40; homolog of yeast EBNA1-binding protein /FL = gb: U86602.1 gb: NM_006824.1" | 201323_at | ribosome biogenesis |
| VIM: vimentin (LOC7431) SEQ ID NOS: 90 (DNA) and 289 (amino acid) | Consensus includes gb: AI922599 /FEA = EST /DB_XREF = gi: 5658563 /DB_XREF = est: wm90b11.x1 /CLONE = IMAGE: 2443197 /UG = Hs.297753 vimentin /FL = gb: BC000163.2 gb: NM_003380.1 | 201426_s_at | |
| ZNF258: zinc finger protein 258 (LOC9204) SEQ ID NOS: 91 (DNA) and 290 (amino acid) | "gb: NM_007167.1 /DEF = Homo sapiens zinc finger protein 258 (ZNF258), mRNA. /FEA = mRNA /GEN = ZNF258 /PROD = zinc finger protein 258 /DB_XREF = gi: 6005977 /UG = Hs.301637 zinc finger protein 258 /FL = gb: AF055470.1 gb: NM_007167.1" | 219924_s_at | development |
| SGCE: sarcoglycan, epsilon (LOC8910) SEQ ID NOS: 92 (DNA) and 291 (amino acid) | "gb: NM_003919.1 /DEF = Homo sapiens sarcoglycan, epsilon (SGCE), mRNA. /FEA = mRNA /GEN = SGCE /PROD = sarcoglycan, epsilon /DB_XREF = gi: 10835046 /UG = Hs.110708 sarcoglycan, epsilon /FL = gb: NM_003919.1 gb: AF036364.1" | 204688_at | muscle development |
| CD44: CD44 antigen (homing | "gb: M24915.1 /DEF = Human CDw44 antigen, complete cds. /FEA = mRNA | 204490_s_at | cell-cell adhesion |

TABLE 1-continued

BIOMARKERS (SENSITIVE)

| Unigene title and SEQ ID NO: | Affymetrix Description | Affymetrix Probe Set | Gene Ontology |
|---|---|---|---|
| function and Indian blood group system) (LOC960) SEQ ID NOS: 93 (DNA) and 292 (amino acid) | /DB_XREF = gi: 180196 /UG = Hs.169610 CD44 antigen (homing function and Indian blood group system) /FL = gb: NM_000610.1 gb: U40373.1 gb: M59040.1 gb: M24915.1" | | |
| SHCBP1: likely ortholog of mouse Shc SH2-domain binding protein 1 (LOC79801) SEQ ID NOS: 94 (DNA) and 293 (amino acid) | "gb: NM_024745.1 /DEF = *Homo sapiens* hypothetical protein FLJ22009 (FLJ22009), mRNA. /FEA = mRNA /GEN = FLJ22009 /PROD = hypothetical protein FLJ22009 /DB_XREF = gi: 13376069 /UG = Hs.123253 hypothetical protein FLJ22009 /FL = gb: NM_024745.1" | 219493_at | |
| IMP-3: IGF-II mRNA-binding protein 3 (LOC10643) SEQ ID NOS: 95 (DNA) and 294 (amino acid) | "gb: NM_006547.1 /DEF = *Homo sapiens* IGF-II mRNA-binding protein 3 (KOC1), mRNA. /FEA = mRNA /GEN = KOC1 /PROD = IGF-II mRNA-binding protein 3 /DB_XREF = gi: 5729900 /UG = Hs.79440 IGF-II mRNA-binding protein 3 /FL = gb: U97188.1 gb: U76705.1 gb: AF117108.1 gb: NM_006547.1" | 203820_s_at | protein biosynthesis |
| BTG3: BTG family, member 3 (LOC10950) SEQ ID NOS: 96 (DNA) and 295 (amino acid) | "gb: NM_006806.1 /DEF = *Homo sapiens* BTG family, member 3 (BTG3), mRNA. /FEA = mRNA /GEN = BTG3 /PROD = BTG family, member 3 /DB_XREF = gi: 5802989 /UG = Hs.77311 BTG family, member 3 /FL = gb: D64110.1 gb: NM_006806.1" | 205548_s_at | regulation of cell cycle |
| RAI14: retinoic acid induced 14 (LOC26064) SEQ ID NOS: 97 (DNA) and 296 (amino acid) | "gb: NM_015577.1 /DEF = *Homo sapiens* novel retinal pigment epithelial gene (NORPEG), mRNA. /FEA = mRNA /GEN = NORPEG /PROD = DKFZP564G013 protein /DB_XREF = gi: 13470085 /UG = Hs.15165 novel retinal pigment epithelial gene /FL = gb: NM_015577.1 gb: AF155135.1" | 202052_s_at | |
| QKI: quaking homolog, KH domain RNA binding (mouse) (LOC9444) SEQ ID NOS: 98 (DNA) and 297 (amino acid) | Consensus includes gb: AA149639 /FEA = EST /DB_XREF = gi: 1720440 /DB_XREF = est: zl39c06.s1 /CLONE = IMAGE: 504298 /UG = Hs.15020 homolog of mouse quaking QKI (KH domain RNA binding protein) /FL = gb: AF142419.1 gb: AF142422.1 | 212262_at | signal transduction |
| CGI-100: CGI-100 protein (LOC50999) SEQ ID NOS: 99 (DNA) and 298 (amino acid) | "Consensus includes gb: AL117354 /DEF = Human DNA sequence from clone RP5-976O13 on chromosome 1p21.2-22.2 Contains part of the gene for CGI-100 protein, 3 isoforms of the gene for M96 protein, ESTs, STSs, GSSs and a CpG Island /FEA = mRNA_1 /DB_XREF = gi: 6822199 /UG = Hs.296155 CGI-100 protein /FL = gb: AF151858.1 gb: NM_016040.1" | 202194_at | intracellular protein transport |
| CTSZ: cathepsin Z (LOC1522) SEQ ID NOS: 100 (DNA) and 299 (amino acid) | "gb: AF073890.1 /DEF = *Homo sapiens* cathepsin X precursor, mRNA, complete cds. /FEA = mRNA /PROD = cathepsin X precursor /DB_XREF = gi: 3650497 /UG = Hs.252549 cathepsin Z /FL = gb: AF032906.1 gb: AF073890.1 gb: NM_001336.1 gb: AF136273.1" | 210042_s_at | proteolysis and peptidolysis |

The biomarkers provided in Table 2 include the nucleotide sequences of SEQ ID NOS:101-200 and the amino acid sequences of SEQ ID NOS:300-395.

TABLE 2

| | BIOMARKERS (RESISTANT) | | |
|---|---|---|---|
| Unigene title and SEQ ID NO: | Affymetrix Description | Affymetrix Probe Set | Gene Ontology |
| GATA3: GATA binding protein 3 (LOC2625) SEQ ID NOS: 101 (DNA) and 300 (amino acid) | "gb: BC003070.1 /DEF = *Homo sapiens*, GATA-binding protein 3, clone MGC: 2346, mRNA, complete cds. /FEA = mRNA /PROD = GATA-binding protein 3 /DB_XREF = gi: 13111765 /UG = Hs.169946 GATA-binding protein 3 /FL = gb: BC003070.1 gb: M69106.1 gb: NM_002051.1" | 209604_s_at | proteolysis and peptidolysis |
| TFF1: trefoil factor 1 (breast cancer, estrogen-inducible sequence expressed in) (LOC7031) SEQ ID NOS: 102 (DNA) and 301 (amino acid) | "gb: NM_003225.1 /DEF = *Homo sapiens* trefoil factor 1 (breast cancer, estrogen-inducible sequence expressed in) (TFF1), mRNA. /FEA = mRNA /GEN = TFF1 /PROD = trefoil factor 1 (breast cancer, estrogen-inducible sequence expressed in) /DB_XREF = gi: 4507450 /UG = Hs.1406 trefoil factor 1 (breast cancer, estrogen-inducible sequence expressed in) /FL = gb: NM_003225.1" | 205009_at | carbohydrate metabolism, cell growth and/or maintenance |
| ZFYVE21: zinc finger, FYVE domain containing 21 (LOC79038) SEQ ID NOS: 103 (DNA) and 302 (amino acid) | "gb: NM_024071.1 /DEF = *Homo sapiens* hypothetical protein MGC2550 (MGC2550), mRNA. /FEA = mRNA /GEN = MGC2550 /PROD = hypothetical protein MGC2550 /DB_XREF = gi: 13129053 /UG = Hs.318498 hypothetical protein MGC2550 /FL = gb: BC001130.1 gb: NM_024071.1" | 219929_s_at | |
| ATP5G2: ATP synthase, H+ transporting, mitochondrial F0 complex, subunit c (subunit 9), isoform 2 (LOC517) SEQ ID NOS: 104 (DNA) and 303 (amino acid) | "gb: D13119.1 /DEF = *Homo sapiens* P2 mRNA for ATP synthase subunit c, complete cds. /FEA = mRNA /GEN = P2 /PROD = ATP synthase subunit c precursor /DB_XREF = gi: 285909 /UG = Hs.89399 ATP synthase, H+ transporting, mitochondrial F0 complex, subunit c (subunit 9), isoform 2 /FL = gb: D13119.1" | 208764_s_at | proton transport |
| EGFL5: EGF-like-domain, multiple 5 (LOC1955) SEQ ID NOS: 105 (DNA) and 304 (amino acid) | "Consensus includes gb: W68084 /FEA = EST /DB_XREF = gi: 1376954 /DB_XREF = est: zd42f12.s1 /CLONE = IMAGE: 343343 /UG = Hs.5599 EGF-like-domain, multiple 5" | 212830_at | metabolism |
| MCCC2: methylcrotonoyl-Coenzyme A carboxylase 2 (beta) (LOC64087) SEQ ID NOS: 106 (DNA) and 305 (amino acid) | "gb: AB050049.1 /DEF = *Homo sapiens* mccb mRNA for non-biotin containing subunit of 3-methylcrotonyl-CoA carboxylase, complete cds. /FEA = mRNA /GEN = mccb /PROD = non-biotin containing subunit of 3-methylcrotonyl-CoA carboxylase /DB_XREF = gi: 10934058 /UG = Hs.167531 methylcrotonoyl-Coenzyme A carboxylase 2 (beta) /FL = gb: AB050049.1 gb: AF310971.1 gb: AF301000.1 gb: NM_022132.2" | 209624_s_at | leucine catabolism |
| ABAT: 4-aminobutyrate aminotransferase (LOC18) SEQ ID NOS: 107 (DNA) and 306 (amino acid) | "gb: AF237813.1 /DEF = *Homo sapiens* NPD009 mRNA, complete cds. /FEA = mRNA /PROD = NPD009 /DB_XREF = gi: 9963907 /UG = Hs.283675 NPD009 protein /FL = gb: NM_020686.1 gb: AF237813.1" | 209460_at | |
| —: Clone IMAGE: 3869896, mRNA (LOC388434) SEQ ID NOS: 108 (DNA) | "Consensus includes gb: AV700224 /FEA = EST /DB_XREF = gi: 10302195 /DB_XREF = est: AV700224 /CLONE = GKCARG01 /UG = Hs.75852 casein kinase 1, delta /FL = gb: BC003558.1" | 208774_at | signal transduction |

TABLE 2-continued

BIOMARKERS (RESISTANT)

| Unigene title and SEQ ID NO: | Affymetrix Description | Affymetrix Probe Set | Gene Ontology |
|---|---|---|---|
| FEM1B: fem-1 homolog b (*C. elegans*) (LOC10116) SEQ ID NOS: 109 (DNA) and 307 (amino acid) | Consensus includes gb: AI799061 /FEA = EST /DB_XREF = gi: 5364533 /DB_XREF = est: we98a10.x1 /CLONE = IMAGE: 2349114 /UG = Hs.6048 FEM-1 (*C. elegans*) homolog b /FL = gb: AF178632.1 gb: NM_015322.1 gb: AF204883.1 | 212367_at | induction of apoptosis |
| SLC35A1: solute carrier family 35 (CMP-sialic acid transporter), member A1 (LOC10559) SEQ ID NOS: 110 (DNA) and 308 (amino acid) | "gb: NM_006416.1 /DEF = *Homo sapiens* solute carrier family 35 (CMP-sialic acid transporter), member 1 (SLC35A1), mRNA. /FEA = mRNA /GEN = SLC35A1 /PROD = solute carrier family 35 (CMP-sialic acidtransporter), member 1 /DB_XREF = gi: 5453620 /UG = Hs.82921 solute carrier family 35 (CMP-sialic acid transporter), member 1 /FL = gb: D87969.1 gb: NM_006416.1" | 203306_s_at | |
| ZNF607: zinc finger protein 607 (LOC84775) SEQ ID NOS: 111 (DNA) and 309 (amino acid) | Consensus includes gb: AL560017 /FEA = EST /DB_XREF = gi: 12906073 /DB_XREF = est: AL560017 /CLONE = CS0DG004YD08 (5 prime) /UG = Hs.75323 prohibitin /FL = gb: NM_002634.2 | 200658_s_at | DNA metabolism |
| FLJ11164: hypothetical protein FLJ11164 (LOC55316) SEQ ID NOS: 112 (DNA) and 310 (amino acid) | "gb: NM_018346.1 /DEF = *Homo sapiens* hypothetical protein FLJ11164 (FLJ11164), mRNA. /FEA = mRNA /GEN = FLJ11164 /PROD = hypothetical protein FLJ11164 /DB_XREF = gi: 8922910 /UG = Hs.8033 hypothetical protein FLJ11164 /FL = gb: NM_018346.1" | 218307_at | |
| ABAT: 4-aminobutyrate aminotransferase (LOC18) SEQ ID NOS: 113 (DNA) and 311 (amino acid) | "gb: NM_000663.1 /DEF = *Homo sapiens* 4-aminobutyrate aminotransferase (ABAT), nuclear gene encoding mitochondrial protein, mRNA. /FEA = mRNA /GEN = ABAT /PROD = 4-aminobutyrate aminotransferase precursor /DB_XREF = gi: 4501846 /UG = Hs.1588 4-aminobutyrate aminotransferase /FL = gb: NM_000663.1 gb: L32961.1" | 206527_at | aminobutyrate metabolism |
| SLC19A2: solute carrier family 19 (thiamine transporter), member 2 (LOC10560) SEQ ID NOS: 114 (DNA) and 312 (amino acid) | "gb: AF153330.1 /DEF = *Homo sapiens* thiamine carrier 1 (TC1) mRNA, complete cds. /FEA = mRNA /GEN = TC1 /PROD = thiamine carrier 1 /DB_XREF = gi: 5453325 /UG = Hs.30246 solute carrier family 19 (thiamine transporter), member 2 /FL = gb: AF153330.1 gb: AF135488.1 gb: AF160812.1" | 209681_at | small molecule transport |
| SLC9A3R1: solute carrier family 9 (sodium/hydrogen exchanger), isoform 3 regulator 1 (LOC9368) SEQ ID NOS: 115 (DNA) and 313 (amino acid) | "gb: NM_004252.1 /DEF = *Homo sapiens* solute carrier family 9 (sodiumhydrogen exchanger), isoform 3 regulatory factor 1 (SLC9A3R1), mRNA. /FEA = mRNA /GEN = SLC9A3R1 /PROD = solute carrier family 9 (sodiumhydrogenexchanger), isoform 3 regulatory factor 1 /DB_XREF = gi: 4759139 /UG = Hs.184276 solute carrier family 9 (sodiumhydrogen exchanger), isoform 3 regulatory factor 1 /FL = gb: BC001443.1 gb: BC003361.1 gb: AF036241.1 gb: AF015926.1 gb: NM_004252.1" | 201349_at | intracellular signaling cascade |
| ICA1: islet cell autoantigen 1, 69 kDa (LOC3382) SEQ ID NOS: 116 (DNA) and 314 (amino acid) | "gb: L21181.1 /DEF = Human autoantigen p69 mRNA, complete cds. /FEA = mRNA /PROD = autoantigen p69 /DB_XREF = gi: 437366 /UG = Hs.167927 islet cell autoantigen 1 (69 kD) /FL = gb: L21181.1" | 210547_x_at | |
| CIRBP: cold inducible RNA binding protein (LOC1153) SEQ ID NOS: 117 | "gb: NM_001280.1 /DEF = *Homo sapiens* cold inducible RNA-binding protein (CIRBP), mRNA. /FEA = mRNA /GEN = CIRBP /PROD = cold inducible RNA-binding protein | 200811_at | response to cold |

TABLE 2-continued

BIOMARKERS (RESISTANT)

| Unigene title and SEQ ID NO: | Affymetrix Description | Affymetrix Probe Set | Gene Ontology |
|---|---|---|---|
| (DNA) and 315 (amino acid) | /DB_XREF = gi: 4502846 /UG = Hs.119475 cold inducible RNA-binding protein /FL = gb: D78134.1 gb: BC000403.1 gb: BC000901.1 gb: AF021336.1 gb: NM_001280.1" | | |
| C14orf114: chromosome 14 open reading frame 114 (LOC55218) SEQ ID NOS: 118 (DNA) and 316 (amino acid) | "gb: NM_018199.1 /DEF = *Homo sapiens* hypothetical protein FLJ10738 (FLJ10738), mRNA. /FEA = mRNA /GEN = FLJ10738 /PROD = hypothetical protein FLJ10738 /DB_XREF = gi: 8922630 /UG = Hs.5457 hypothetical protein FLJ10738 /FL = gb: BC001962.1 gb: NM_018199.1" | 218363_at | |
| GREB1: GREB1 protein (LOC9687) SEQ ID NOS: 119 (DNA) and 317 (amino acid) | "gb: NM_014668.1 /DEF = *Homo sapiens* KIAA0575 gene product (KIAA0575), mRNA. /FEA = mRNA /GEN = KIAA0575 /PROD = KIAA0575 gene product /DB_XREF = gi: 7662187 /UG = Hs.193914 KIAA0575 gene product /FL = gb: AB011147.1 gb: NM_014668.1" | 205862_at | |
| ESR1: estrogen receptor 1 (LOC2099) SEQ ID NOS: 120 (DNA) and 318 (amino acid) | "gb: NM_000125.1 /DEF = *Homo sapiens* estrogen receptor 1 (ESR1), mRNA. /FEA = mRNA /GEN = ESR1 /PROD = estrogen receptor 1 /DB_XREF = gi: 4503602 /UG = Hs.1657 estrogen receptor 1 /FL = gb: NM_000125.1" | 205225_at | nuclear hormone receptor, cellular proliferation and differentiation |
| ABAT: 4-aminobutyrate aminotransferase (LOC18) SEQ ID NOS: 121 (DNA) and 319 (amino acid) | "gb: AF237813.1 /DEF = *Homo sapiens* NPD009 mRNA, complete cds. /FEA = mRNA /PROD = NPD009 /DB_XREF = gi: 9963907 /UG = Hs.283675 NPD009 protein /FL = gb: NM_020686.1 gb: AF237813.1" | 209459_s_at | |
| ABCG1: ATP-binding cassette, sub-family G (WHITE), member 1 (LOC9619) SEQ ID NOS: 122 (DNA) and 320 (amino acid) | "gb: NM_004915.2 /DEF = *Homo sapiens* ATP-binding cassette, sub-family G (WHITE), member 1 (ABCG1), transcript variant 1, mRNA. /FEA = mRNA /GEN = ABCG1 /PROD = ATP-binding cassette sub-family G member 1 isoform a /DB_XREF = gi: 8051574 /UG = Hs.10237 ATP-binding cassette, sub-family G (WHITE), member 1 /FL = gb: NM_004915.2" | 204567_s_at | small molecule transport |
| SLC35B1: solute carrier family 35, member B1 (LOC10237) SEQ ID NOS: 123 (DNA) and 321 (amino acid) | "gb: NM_005827.1 /DEF = *Homo sapiens* UDP-galactose transporter related (UGTREL1), mRNA. /FEA = mRNA /GEN = UGTREL1 /PROD = UDP-galactose transporter related /DB_XREF = gi: 5032212 /UG = Hs.154073 UDP-galactose transporter related /FL = gb: D87989.1 gb: NM_005827.1" | 202433_at | transport |
| TOB1: transducer of ERBB2, 1 (LOC10140) SEQ ID NOS: 124 (DNA) and 322 (amino acid) | "Consensus includes gb: AA675892 /FEA = EST /DB_XREF = gi: 2775239 /DB_XREF = est: b03503s /CLONE = b03503 /UG = Hs.178137 transducer of ERBB2, 1 /FL = gb: D38305.1 gb: NM_005749.1" | 202704_at | negative regulation of cell proliferation |
| FOXA1: forkhead box A1 (LOC3169) SEQ ID NOS: 125 (DNA) and 323 (amino acid) | "gb: NM_004496.1 /DEF = *Homo sapiens* hepatocyte nuclear factor 3, alpha (HNF3A), mRNA. /FEA = mRNA /GEN = HNF3A /PROD = hepatocyte nuclear factor 3, alpha /DB_XREF = gi: 4758533 /UG = Hs.299867 hepatocyte nuclear factor 3, alpha /FL = gb: U39840.1 gb: NM_004496.1" | 204667_at | regulation of transcription, DNA-dependent |
| LARGE: like-glycosyltransferase (LOC9215) SEQ ID NOS: 126 | "Consensus includes gb: AB011181.2 /DEF = *Homo sapiens* mRNA for KIAA0609 protein, partial cds. /FEA = mRNA /GEN = KIAA0609 | 215543_s_at | muscle maintenance, glycosphingolipid biosynthesis |

TABLE 2-continued

BIOMARKERS (RESISTANT)

| Unigene title and SEQ ID NO: | Affymetrix Description | Affymetrix Probe Set | Gene Ontology |
|---|---|---|---|
| (DNA) and 324 (amino acid) | /PROD = KIAA0609 protein /DB_XREF = gi: 6683718 /UG = Hs.25220 like-glycosyltransferase" | | |
| AKT1: v-akt murine thymoma viral oncogene homolog 1 (LOC207) SEQ ID NOS: 127 (DNA) and 325 (amino acid) | "gb: NM_005163.1 /DEF = Homo sapiens v-akt murine thymoma viral oncogene homolog 1 (AKT1), mRNA. /FEA = mRNA /GEN = AKT1 /PROD = serinethreonine protein kinase /DB_XREF = gi: 4885060 /UG = Hs.71816 v-akt murine thymoma viral oncogene homolog 1 /FL = gb: M63167.1 gb: NM_005163.1" | 207163_s_at | signal transduction |
| CTPS2: CTP synthase II (LOC56474) SEQ ID NOS: 128 (DNA) and 326 (amino acid) | "gb: NM_019857.1 /DEF = Homo sapiens CTP synthase II (CTPS2), mRNA. /FEA = mRNA /GEN = CTPS2 /PROD = CTP synthase II /DB_XREF = gi: 9789918 /UG = Hs.58553 CTP synthase II /FL = gb: AF226667.1 gb: NM_019857.1" | 219080_s_at | |
| RBM8A: RNA binding motif protein 8A (LOC9939) SEQ ID NOS: 129 (DNA) and 327 (amino acid) | Consensus includes gb: AI738479 /FEA = EST /DB_XREF = gi: 5100460 /DB_XREF = est: wi32d06.x1 /CLONE = IMAGE: 2391947 /UG = Hs.65648 RNA binding motif protein 8A | 214113_s_at | nuclear mRNA splicing, via spliceosome |
| SIAH2: seven in absentia homolog 2 (Drosophila) (LOC6478) SEQ ID NOS: 130 (DNA) and 328 (amino acid) | "gb: U76248.1 /DEF = Human hSIAH2 mRNA, complete cds. /FEA = mRNA /PROD = hSIAH2 /DB_XREF = gi: 2673967 /UG = Hs.20191 seven in absentia (Drosophila) homolog 2 /FL = gb: U76248.1 gb: NM_005067.1" | 209339_at | small GTPase mediated signal transduction |
| FLJ13855: hypothetical protein FLJ13855 (LOC65264) SEQ ID NOS: 131 (DNA) and 329 (amino acid) | "gb: NM_023079.1 /DEF = Homo sapiens hypothetical protein FLJ13855 (FLJ13855), mRNA. /FEA = mRNA /GEN = FLJ13855 /PROD = hypothetical protein FLJ13855 /DB_XREF = gi: 12751494 /UG = Hs.168232 hypothetical protein FLJ13855 /FL = gb: NM_023079.1" | 217750_s_at | ubiquitin cycle |
| ITPK1: inositol 1,3,4-triphosphate 5/6 kinase (LOC3705) SEQ ID NOS: 132 (DNA) and 330 (amino acid) | "gb: AF279372.1 /DEF = Homo sapiens inositol 1,3,4-trisphosphate 56-kinase mRNA, complete cds. /FEA = mRNA /PROD = inositol 1,3,4-trisphosphate 56-kinase /DB_XREF = gi: 12006345 /UG = Hs.6453 inositol 1,3,4-triphosphate 56 kinase /FL = gb: AF279372.1" | 210740_s_at | signal transduction |
| SEPX1: selenoprotein X, 1 (LOC51734) SEQ ID NOS: 133 (DNA) and 331 (amino acid) | "gb: NM_016332.1 /DEF = Homo sapiens selenoprotein X, 1 (SEPX1), mRNA. /FEA = mRNA /GEN = SEPX1 /PROD = selenoprotein X, 1 /DB_XREF = gi: 7706510 /UG = Hs.279623 selenoprotein X, 1 /FL = gb: AF187272.1 gb: BC003127.1 gb: AF166124.1 gb: NM_016332.1" | 217977_at | |
| IRX5: iroquois homeobox protein 5 (LOC10265) SEQ ID NOS: 134 (DNA) and 332 (amino acid) | "gb: U90304.1 /DEF = Human iroquois-class homeodomain protein IRX-2a mRNA, complete cds. /FEA = mRNA /PROD = iroquois-class homeodomain protein IRX-2a /DB_XREF = gi: 1899219 /UG = Hs.25351 iroquois homeobox protein 5 /FL = gb: U90304.1 gb: NM_005853.1" | 210239_at | regulation of transcription, DNA-dependent |
| PTEN: phosphatase and tensin homolog (mutated in multiple advanced cancers 1) (LOC5728) SEQ ID NOS: 135 (DNA) and 333 (amino acid) | "gb: BC005821.1 /DEF = Homo sapiens, phosphatase and tensin homolog (mutated in multiple advanced cancers 1), clone MGC: 11227, mRNA, complete cds. /FEA = mRNA /PROD = phosphatase and tensin homolog (mutated inmultiple advanced cancers 1) /DB_XREF = gi: 13543309 /FL = gb: BC005821.1" | 211711_s_at | regulation of CDK activity |

TABLE 2-continued

BIOMARKERS (RESISTANT)

| Unigene title and SEQ ID NO: | Affymetrix Description | Affymetrix Probe Set | Gene Ontology |
|---|---|---|---|
| DP1: polyposis locus protein 1 (LOC7905) SEQ ID NOS: 136 (DNA) and 334 (amino acid) | "gb: BC000232.1 /DEF = *Homo sapiens*, Similar to deleted in polyposis 1, clone MGC: 2267, mRNA, complete cds. /FEA = mRNA /PROD = Similar to deleted in polyposis 1 /DB_XREF = gi: 12652946 /UG = Hs.178112 DNA segment, single copy probe LNS-CAILNS-CAII (deleted in polyposis /FL = gb: BC000232.1" | 208873_s_at | |
| KIAA1002: KIAA1002 protein (LOC22864) SEQ ID NOS: 137 (DNA) and 335 (amino acid) | "gb: NM_014925.1 /DEF = *Homo sapiens* KIAA1002 protein (KIAA1002), mRNA. /FEA = mRNA /GEN = KIAA1002 /PROD = KIAA1002 protein /DB_XREF = gi: 7662441 /UG = Hs.102483 KIAA1002 protein /FL = gb: AB023219.1 gb: AF113695.1 gb: NM_014925.1" | 203831_at | |
| PDCD4: programmed cell death 4 (neoplastic transformation inhibitor) (LOC27250) SEQ ID NOS: 138 (DNA) and 336 (amino acid) | "Consensus includes gb: N92498 /FEA = EST /DB_XREF = gi: 1264807 /DB_XREF = est: zb28a04.s1 /CLONE = IMAGE: 304878 /UG = Hs.326248 *Homo sapiens* cDNA: FLJ22071 fis, clone HEP11691" | 212593_s_at | apoptosis |
| APPBP2: amyloid beta precursor protein (cytoplasmic tail) binding protein 2 (LOC10513) SEQ ID NOS: 139 (DNA) and 337 (amino acid) | Consensus includes gb: AV681579 /FEA = EST /DB_XREF = gi: 10283442 /DB_XREF = est: AV681579 /CLONE = GKBAFE05 /UG = Hs.84084 amyloid beta precursor protein (cytoplasmic tail)-binding protein 2 /FL = gb: AF017782.1 gb: NM_006380.1 | 202629_at | intracellular protein transport |
| ACVR1B: activin A receptor, type IB (LOC91) SEQ ID NOS: 140 (DNA) and 338 (amino acid) | Consensus includes gb: AL117643.1 /DEF = *Homo sapiens* mRNA; cDNA DKFZp434M245 (from clone DKFZp434M245). /FEA = mRNA /DB_XREF = gi: 5912233 /UG = Hs.5288 *Homo sapiens* mRNA; cDNA DKFZp434M245 (from clone DKFZp434M245) | 213198_at | transmembrane receptor protein serine/threonine kinase signaling pathway |
| TLE3: transducin-like enhancer of split 3 (E(sp1) homolog, *Drosophila*) (LOC7090) SEQ ID NOS: 141 (DNA) and 339 (amino acid) | Consensus includes gb: AW873621 /FEA = EST /DB_XREF = gi: 8007674 /DB_XREF = est: ho64d03.x1 /CLONE = IMAGE: 3042149 /UG = Hs.31305 KIAA1547 protein | 212770_at | regulation of transcription, DNA-dependent |
| CIRBP: cold inducible RNA binding protein (LOC1153) SEQ ID NOS: 142 (DNA) and 340 (amino acid) | "gb: NM_001280.1 /DEF = *Homo sapiens* cold inducible RNA-binding protein (CIRBP), mRNA. /FEA = mRNA /GEN = CIRBP /PROD = cold inducible RNA-binding protein /DB_XREF = gi: 4502846 /UG = Hs.119475 cold inducible RNA-binding protein /FL = gb: D78134.1 gb: BC000403.1 gb: BC000901.1 gb: AF021336.1 gb: NM_001280.1" | 200810_s_at | response to cold |
| ABCA3: ATP-binding cassette, sub-family A (ABC1), member 3 (LOC21) SEQ ID NOS: 143 (DNA) and 341 (amino acid) | "gb: NM_001089.1 /DEF = *Homo sapiens* ATP-binding cassette, sub-family A (ABC1), member 3 (ABCA3), mRNA. /FEA = mRNA /GEN = ABCA3 /PROD = ATP-binding cassette, sub-family A member 3 /DB_XREF = gi: 4501848 /UG = Hs.26630 ATP-binding cassette, sub-family A (ABC1), member 3 /FL = gb: U78735.1 gb: NM_001089.1" | 204343_at | drug resistance |
| MTSS1: metastasis suppressor 1 | "gb: NM_014751.1 /DEF = *Homo sapiens* KIAA0429 gene product (KIAA0429), mRNA. /FEA = mRNA /GEN = KIAA0429 | 203037_s_at | |

TABLE 2-continued

BIOMARKERS (RESISTANT)

| Unigene title and SEQ ID NO: | Affymetrix Description | Affymetrix Probe Set | Gene Ontology |
|---|---|---|---|
| (LOC9788) SEQ ID NOS: 144 (DNA) and 342 (amino acid) | /PROD = KIAA0429 gene product /DB_XREF = gi: 7662113 /UG = Hs.77694 KIAA0429 gene product /FL = gb: AB007889.1 gb: NM_014751.1" | | |
| CA12: carbonic anhydrase XII (LOC771) SEQ ID NOS: 145 (DNA) and 343 (amino acid) | "gb: NM_001218.2 /DEF = *Homo sapiens* carbonic anhydrase XII (CA12), mRNA. /FEA = mRNA /GEN = CA12 /PROD = carbonic anhydrase XII precursor /DB_XREF = gi: 9951924 /UG = Hs.5338 carbonic anhydrase XII /FL = gb: AF037335.1 gb: AF051882.1 gb: NM_001218.2" | 203963_at | one-carbon compound metabolism |
| FRAT2: frequently rearranged in advanced T-cell lymphomas 2 (LOC23401) SEQ ID NOS: 146 (DNA) and 344 (amino acid) | "gb: AB045118.1 /DEF = *Homo sapiens* FRAT2 mRNA, complete cds. /FEA = mRNA /GEN = FRAT2 /PROD = FRAT2 /DB_XREF = gi: 13365650 /UG = Hs.140720 GSK-3 binding protein FRAT2 /FL = gb: AB045118.1" | 209864_at | |
| SUPT4H1: suppressor of Ty 4 homolog 1 (*S. cerevisiae*) (LOC6827) SEQ ID NOS: 147 (DNA) and 345 (amino acid) | "gb: NM_003168.1 /DEF = *Homo sapiens* suppressor of Ty (*S. cerevisiae*) 4 homolog 1 (SUPT4H1), mRNA. /FEA = mRNA /GEN = SUPT4H1 /PROD = suppressor of Ty (*S. cerevisiae*) 4 homolog 1 /DB_XREF = gi: 4507310 /UG = Hs.79058 suppressor of Ty (*S. cerevisiae*) 4 homolog 1 /FL = gb: BC002802.1 gb: U43923.1 gb: U38818.1 gb: U38817.1 gb: NM_003168.1" | 201484_at | chromatin modeling |
| UBPH: similar to ubiquitin binding protein (LOC56061) SEQ ID NOS: 148 (DNA) and 346 (amino acid) | "gb: NM_019116.1 /DEF = *Homo sapiens* similar to ubiquitin binding protein (UBPH), mRNA. /FEA = mRNA /GEN = UBPH /PROD = similar to ubiquitin binding protein /DB_XREF = gi: 9507222 /UG = Hs.288620 similar to ubiquitin binding protein /FL = gb: NM_019116.1" | 205687_at | |
| MGC50853: hypothetical protein MGC50853 (LOC399665) SEQ ID NOS: 149 (DNA) and 347 (amino acid) | "Consensus includes gb: AL043266 /FEA = EST /DB_XREF = gi: 5935844 /DB_XREF = est: DKFZp434L1423_s1 /CLONE = DKFZp434L1423 /UG = Hs.111334 ferritin, light polypeptide" | 212400_at | |
| TBL1X: transducin (beta)-like 1X-linked (LOC6907) SEQ ID NOS: 150 (DNA) and 348 (amino acid) | Consensus includes gb: AV753028 /FEA = EST /DB_XREF = gi: 10910876 /DB_XREF = est: AV753028 /CLONE = NPDBCD07 /UG = Hs.76536 transducin (beta)-like 1 | 213400_s_at | signal transduction |
| FLJ11280: hypothetical protein FLJ11280 (LOC55793) SEQ ID NOS: 151 (DNA) and 349 (amino acid) | Consensus includes gb: AL561943 /FEA = EST /DB_XREF = gi: 12909874 /DB_XREF = est: AL561943 /CLONE = CS0DB002YO04 (3 prime) /UG = Hs.3346 hypothetical protein FLJ11280 | 221856_s_at | |
| RHOB: ras homolog gene family, member B (LOC388) SEQ ID NOS: 152 (DNA) and 350 (amino acid) | "Consensus includes gb: AI263909 /FEA = EST /DB_XREF = gi: 3872112 /DB_XREF = est: qi08f09.x1 /CLONE = IMAGE: 1855913 /UG = Hs.204354 ras homolog gene family, member B /FL = gb: NM_004040.1" | 212099_at | Rho protein signal transduction |
| LASS6: LAG1 longevity assurance homolog 6 (*S. cerevisiae*) (LOC253782) SEQ ID NOS: 153 | "Consensus includes gb: BG289001 /FEA = EST /DB_XREF = gi: 13044404 /DB_XREF = est: 602381262F1 /CLONE = IMAGE: 4499078 /UG = Hs.101282 *Homo sapiens* cDNA: FLJ21238 fis, clone COL01115" | 212442_s_at | |

TABLE 2-continued

BIOMARKERS (RESISTANT)

| Unigene title and SEQ ID NO: | Affymetrix Description | Affymetrix Probe Set | Gene Ontology |
|---|---|---|---|
| (DNA) and 351 (amino acid) | | | |
| KIAA0515: KIAA0515 (LOC84726) SEQ ID NOS: 154 (DNA) | "Consensus includes gb: AB011087.1 /DEF = *Homo sapiens* mRNA for KIAA0515 protein, partial cds. /FEA = mRNA /GEN = KIAA0515 /PROD = KIAA0515 protein /DB_XREF = gi: 3043553 /UG = Hs.108945 KIAA0515 protein" | 212068_s_at | |
| MCCC2: methylcrotonoyl-Coenzyme A carboxylase 2 (beta) (LOC64087) SEQ ID NOS: 155 (DNA) and 352 (amino acid) | Consensus includes gb: AW439494 /FEA = EST /DB_XREF = gi: 6974800 /DB_XREF = est: xt19c01.x1 /CLONE = IMAGE: 2779584 /UG = Hs.167531 methylcrotonoyl-Coenzyme A carboxylase 2 (beta) /FL = gb: AB050049.1 gb: AF310971.1 gb: AF301000.1 gb: NM_022132.2 | 209623_at | |
| TFF3: trefoil factor 3 (intestinal) (LOC7033) SEQ ID NOS: 156 (DNA) and 353 (amino acid) | "gb: NM_003226.1 /DEF = *Homo sapiens* trefoil factor 3 (intestinal) (TFF3), mRNA. /FEA = mRNA /GEN = TFF3 /PROD = trefoil factor 3 (intestinal) /DB_XREF = gi: 4507452 /UG = Hs.82961 trefoil factor 3 (intestinal) /FL = gb: L08044.1 gb: L15203.1 gb: NM_003226.1" | 204623_at | phosphoenolpyruvate-dependent sugar phosphotransferase system |
| GATA3: GATA binding protein 3 (LOC2625) SEQ ID NOS: 157 (DNA) and 354 (amino acid) | Consensus includes gb: AI796169 /FEA = EST /DB_XREF = gi: 5361632 /DB_XREF = est: wh43d10.x1 /CLONE = IMAGE: 2383507 /UG = Hs.169946 GATA-binding protein 3 /FL = gb: BC003070.1 gb: M69106.1 gb: NM_002051.1 | 209603_at | defense response |
| CEBPA: CCAAT/enhancer binding protein (C/EBP), alpha (LOC1050) SEQ ID NOS: 158 (DNA) and 355 (amino acid) | "gb: NM_004364.1 /DEF = *Homo sapiens* CCAATenhancer binding protein (CEBP), alpha (CEBPA), mRNA. /FEA = mRNA /GEN = CEBPA /PROD = CCAATenhancer binding protein (CEBP), alpha /DB_XREF = gi: 4757971 /UG = Hs.76171 CCAATenhancer binding protein (CEBP), alpha /FL = gb: NM_004364.1" | 204039_at | |
| LOC92482: hypothetical protein LOC92482 (LOC92482) SEQ ID NOS: 159 (DNA) | "Consensus includes gb: AK025724.1 /DEF = *Homo sapiens* cDNA: FLJ22071 fis, clone HEP11691. /FEA = mRNA /DB_XREF = gi: 10438333 /UG = Hs.326248 *Homo sapiens* cDNA: FLJ22071 fis, clone HEP11691" | 213224_s_at | |
| FLJ13910: hypothetical protein FLJ13910 (LOC64795) SEQ ID NOS: 160 (DNA) and 356 (amino acid) | Consensus includes gb: BF671894 /FEA = EST /DB_XREF = gi: 11945789 /DB_XREF = est: 602151796F1 /CLONE = IMAGE: 4292999 /UG = Hs.75277 hypothetical protein FLJ13910 | 212482_at | |
| C14orf130: chromosome 14 open reading frame 130 (LOC55148) SEQ ID NOS: 161 (DNA) and 357 (amino acid) | "gb: NM_018108.1 /DEF = *Homo sapiens* hypothetical protein FLJ10483 (FLJ10483), mRNA. /FEA = mRNA /GEN = FLJ10483 /PROD = hypothetical protein FLJ10483 /DB_XREF = gi: 8922451 /UG = Hs.6877 hypothetical protein FLJ10483 /FL = gb: NM_018108.1" | 218108_at | |
| CDKN1B: cyclin-dependent kinase inhibitor 1B (p27, Kip1) (LOC1027) SEQ ID NOS: 162 (DNA) and 358 (amino acid) | "gb: BC001971.1 /DEF = *Homo sapiens*, Similar to cyclin-dependent kinase inhibitor 1B (p27, Kip1), clone MGC: 5304, mRNA, complete cds. /FEA = mRNA /PROD = Similar to cyclin-dependent kinase inhibitor 1B (p27, Kip1) /DB_XREF = gi: 12805034 /UG = Hs.238990 cyclin-dependent kinase inhibitor 1B (p27, Kip1) /FL = gb: BC001971.1 gb: NM_004064.1 | 209112_at | regulation of CDK activity |

TABLE 2-continued

BIOMARKERS (RESISTANT)

| Unigene title and SEQ ID NO: | Affymetrix Description | Affymetrix Probe Set | Gene Ontology |
|---|---|---|---|
| | gb: U10906.1 gb: AF247551.1 gb: AY004255.1" | | |
| APPBP2: amyloid beta precursor protein (cytoplasmic tail) binding protein 2 (LOC10513) SEQ ID NOS: 163 (DNA) and 359 (amino acid) | "gb: NM_006380.1 /DEF = *Homo sapiens* amyloid beta precursor protein (cytoplasmic tail)-binding protein 2 (APPBP2), mRNA. /FEA = mRNA /GEN = APPBP2 /PROD = amyloid beta precursor protein (cytoplasmictail)-binding protein 2 /DB_XREF = gi: 5453552 /UG = Hs.84084 amyloid beta precursor protein (cytoplasmic tail)-binding protein 2 /FL = gb: AF017782.1 gb: NM_006380.1" | 202631_s_at | intracellular protein transport |
| LOC81558: C/EBP-induced protein (LOC81558) SEQ ID NOS: 164 (DNA) and 360 (amino acid) | "gb: NM_030802.1 /DEF = *Homo sapiens* CEBP-induced protein (LOC81558), mRNA. /FEA = mRNA /GEN = LOC81558 /PROD = CEBP-induced protein /DB_XREF = gi: 13540589 /FL = gb: NM_030802.1" | 221249_s_at | |
| FLJ20274: hypothetical protein FLJ20274 (LOC55623) SEQ ID NOS: 165 (DNA) and 361 (amino acid) | Consensus includes gb: AL134904 /FEA = EST /DB_XREF = gi: 6603091 /DB_XREF = est: DKFZp762M0710_s1 /CLONE = DKFZp762M0710 /UG = Hs.268371 hypothetical protein FLJ20274 | 213025_at | |
| RAB11A: RAB11A, member RAS oncogene family (LOC8766) SEQ ID NOS: 166 (DNA) and 362 (amino acid) | "gb: NM_004663.1 /DEF = *Homo sapiens* RAB11A, member RAS oncogene family (RAB11), mRNA. /FEA = mRNA /GEN = RAB11A /PROD = RAB11A, member RAS oncogene family /DB_XREF = gi: 4758983 /UG = Hs.75618 RAB11A, member RAS oncogene family /FL = gb: AF000231.1 gb: NM_004663.1" | 200864_s_at | intracellular protein transport |
| —: MRNA; cDNA DKFZp313P052 (from clone DKFZp313P052) (LOC387869) SEQ ID NOS: 167 (DNA) and 363 (amino acid) | Consensus includes gb: BE967207 /FEA = EST /DB_XREF = gi: 11773627 /DB_XREF = est: 601661094R1 /CLONE = IMAGE: 3916174 /UG = Hs.165590 ribosomal protein S13 | 212114_at | |
| NPEPPS: aminopeptidase puromycin sensitive (LOC9520) SEQ ID NOS: 168 (DNA) and 364 (amino acid) | "Consensus includes gb: AJ132583.1 /DEF = *Homo sapiens* mRNA for puromycin sensitive aminopeptidase, partial. /FEA = mRNA /PROD = puromycin sensitive aminopeptidase /DB_XREF = gi: 4210725 /UG = Hs.293007 aminopeptidase puromycin sensitive /FL = gb: NM_006310.1" | 201455_s_at | proteolysis and peptidolysis |
| UBL3: ubiquitin-like 3 (LOC5412) SEQ ID NOS: 169 (DNA) and 365 (amino acid) | "gb: AF044221.1 /DEF = *Homo sapiens* HCG-1 protein (HCG-1) mRNA, complete cds. /FEA = mRNA /GEN = HCG-1 /PROD = HCG-1 protein /DB_XREF = gi: 4105251 /UG = Hs.173091 ubiquitin-like 3 /FL = gb: AF044221.1 gb: AL080177.1 gb: NM_007106.1" | 201534_s_at | |
| BAMBI: BMP and activin membrane-bound inhibitor homolog (*Xenopus laevis*) (LOC25805) SEQ ID NOS: 170 (DNA) and 366 (amino acid) | "gb: NM_012342.1 /DEF = *Homo sapiens* putative transmembrane protein (NMA), mRNA. /FEA = mRNA /GEN = NMA /PROD = putative transmembrane protein /DB_XREF = gi: 6912533 /UG = Hs.78776 putative transmembrane protein /FL = gb: U23070.1 gb: NM_012342.1" | 203304_at | |
| GABPB2: GA binding protein transcription factor, beta subunit 2, 47 kDa | "gb: NM_005254.2 /DEF = *Homo sapiens* GA-binding protein transcription factor, beta subunit 1 (53 kD) (GABPB1), transcript variant beta, mRNA. /FEA = mRNA /GEN = GABPB1 | 204618_s_at | regulation of transcription, DNA-dependent |

TABLE 2-continued

BIOMARKERS (RESISTANT)

| Unigene title and SEQ ID NO: | Affymetrix Description | Affymetrix Probe Set | Gene Ontology |
|---|---|---|---|
| (LOC2553) SEQ ID NOS: 171 (DNA) and 367 (amino acid) | /PROD = GA-binding protein transcription factor, betasubunit 1 (53 kD), isoform beta 1 /DB_XREF = gi: 8051592 /UG = Hs.78915 GA-binding protein transcription factor, beta subunit 1 (53 kD) /FL = gb: U13045.1 gb: NM_005254.2" | | |
| MAPT: microtubule-associated protein tau (LOC4137) SEQ ID NOS: 172 (DNA) and 368 (amino acid) | "gb: J03778.1 /DEF = Human microtubule-associated protein tau mRNA, complete cds. /FEA = mRNA /GEN = MTBT1 /DB_XREF = gi: 338684 /UG = Hs.101174 microtubule-associated protein tau /FL = gb: BC000558.1 gb: J03778.1 gb: NM_016841.1" | 206401_s_at | microtubule cytoskeleton organization and biogenesis |
| WBSCR21: Williams Beuren syndrome chromosome region 21 (LOC83451) SEQ ID NOS: 173 (DNA) and 369 (amino acid) | Consensus includes gb: AI923458 /FEA = EST /DB_XREF = gi: 5659422 /DB_XREF = est: wn85h04.x1 /CLONE = IMAGE: 2452663 /UG = Hs.182476 *Homo sapiens* clone PP1226 unknown mRNA | 221927_s_at | |
| ZNF278: zinc finger protein 278 (LOC23598) SEQ ID NOS: 174 (DNA) and 370 (amino acid) | "gb: AF242522.1 /DEF = *Homo sapiens* krueppel-related zinc finger protein SBZF5 mRNA, complete cds. /FEA = mRNA /PROD = krueppel-related zinc finger protein SBZF5 /DB_XREF = gi: 9802041 /UG = Hs.27801 zinc finger protein 278 /FL = gb: AF242522.1" | 211392_s_at | |
| SUPT4H1: suppressor of Ty 4 homolog 1 (*S. cerevisiae*) (LOC6827) SEQ ID NOS: 175 (DNA) and 371 (amino acid) | "gb: BC002802.1 /DEF = *Homo sapiens*, suppressor of Ty (*S. cerevisiae*) 4 homolog 1, clone MGC: 3864, mRNA, complete cds. /FEA = mRNA /PROD = suppressor of Ty (*S. cerevisiae*) 4 homolog 1 /DB_XREF = gi: 12803910 /UG = Hs.79058 suppressor of Ty (*S. cerevisiae*) 4 homolog 1 /FL = gb: BC002802.1 gb: U43923.1 gb: U38818.1 gb: U38817.1 gb: NM_003168.1" | 201483_s_at | chromatin modeling |
| RAB4B: RAB4B, member RAS oncogene family (LOC53916) SEQ ID NOS: 176 (DNA) and 372 (amino acid) | "gb: NM_016154.1 /DEF = *Homo sapiens* ras-related GTP-binding protein 4b (RAB4B), mRNA. /FEA = mRNA /GEN = RAB4B /PROD = ras-related GTP-binding protein 4b /DB_XREF = gi: 7706672 /UG = Hs.279771 *Homo sapiens* TR00071289_m (RAB4B), mRNA /FL = gb: AF165522.1 gb: NM_016154.1" | 219807_x_at | |
| PEX11B: peroxisomal biogenesis factor 11B (LOC8799) SEQ ID NOS: 177 (DNA) and 373 (amino acid) | "gb: NM_003846.1 /DEF = *Homo sapiens* peroxisomal biogenesis factor 11B (PEX11B), mRNA. /FEA = mRNA /GEN = PEX11B /PROD = peroxisomal biogenesis factor 11B /DB_XREF = gi: 4505718 /UG = Hs.83023 peroxisomal biogenesis factor 11B /FL = gb: AF093670.1 gb: AB018080.1 gb: NM_003846.1" | 202658_at | peroxisome organization and biogenesis |
| LASS6: LAG1 longevity assurance homolog 6 (*S. cerevisiae*) (LOC253782) SEQ ID NOS: 178 (DNA) and 374 (amino acid) | "Consensus includes gb: AI658534 /FEA = EST /DB_XREF = gi: 4762104 /DB_XREF = est: tu17g01.x1 /CLONE = IMAGE: 2251344 /UG = Hs.101282 *Homo sapiens* cDNA: FLJ21238 fis, clone COL01115" | 212446_s_at | |
| C10orf86: chromosome 10 open reading frame 86 (LOC54780) SEQ ID NOS: 179 | "gb: BC005212.1 /DEF = *Homo sapiens*, Similar to hypothetical protein FLJ20003, clone MGC: 12228, mRNA, complete cds. /FEA = mRNA /PROD = Similar to hypothetical protein FLJ20003 /DB_XREF = gi: 13528824 | 211376_s_at | |

TABLE 2-continued

BIOMARKERS (RESISTANT)

| Unigene title and SEQ ID NO: | Affymetrix Description | Affymetrix Probe Set | Gene Ontology |
|---|---|---|---|
| (DNA) and 375 (amino acid) | /UG = Hs.258798 hypothetical protein FLJ20003 /FL = gb: BC005212.1" | | |
| PLEKHF2: pleckstrin homology domain containing, family F (with FYVE domain) member 2 (LOC79666) SEQ ID NOS: 180 (DNA) and 376 (amino acid) | "gb: NM_024613.1 /DEF = *Homo sapiens* hypothetical protein FLJ13187 (FLJ13187), mRNA. /FEA = mRNA /GEN = FLJ13187 /PROD = hypothetical protein FLJ13187 /DB_XREF = gi: 13375826 /UG = Hs.29724 hypothetical protein FLJ13187 /FL = gb: NM_024613.1" | 218640_s_at | |
| KIAA0261: KIAA0261 (LOC23063) SEQ ID NOS: 181 (DNA) and 377 (amino acid) | "Consensus includes gb: D87450.1 /DEF = Human mRNA for KIAA0261 gene, partial cds. /FEA = mRNA /GEN = KIAA0261 /DB_XREF = gi: 1665788 /UG = Hs.154978 KIAA0261 protein" | 212267_at | |
| TIP120A: TBP-interacting protein (LOC55832) SEQ ID NOS: 182 (DNA) and 378 (amino acid) | gb: AL136810.1 /DEF = *Homo sapiens* mRNA; cDNA DKFZp434G0222 (from clone DKFZp434G0222); complete cds. /FEA = mRNA /GEN = DKFZp434G0222 /PROD = hypothetical protein /DB_XREF = gi: 12053130 /UG = Hs.184786 TBP-interacting protein /FL = gb: AL136810.1 | 208839_s_at | |
| GATA3: GATA binding protein 3 (LOC2625) SEQ ID NOS: 183 (DNA) and 379 (amino acid) | Consensus includes gb: AI796169 /FEA = EST /DB_XREF = gi: 5361632 /DB_XREF = est: wh43d10.x1 /CLONE = IMAGE: 2383507 /UG = Hs.169946 GATA-binding protein 3 /FL = gb: BC003070.1 gb: M69106.1 gb: NM_002051.1 | 209602_s_at | defense response |
| CGI-85: CGI-85 protein (LOC51111) SEQ ID NOS: 184 (DNA) and 380 (amino acid) | "gb: NM_017635.1 /DEF = *Homo sapiens* hypothetical protein FLJ20039 (FLJ20039), mRNA. /FEA = mRNA /GEN = FLJ20039 /PROD = hypothetical protein FLJ20039 /DB_XREF = gi: 8923045 /UG = Hs.267448 hypothetical protein FLJ20039 /FL = gb: NM_017635.1" | 218242_s_at | |
| C20orf11: chromosome 20 open reading frame 11 (LOC54994) SEQ ID NOS: 185 (DNA) and 381 (amino acid) | "gb: NM_017896.1 /DEF = *Homo sapiens* hypothetical protein FLJ20602 (FLJ20602), mRNA. /FEA = mRNA /GEN = FLJ20602 /PROD = hypothetical protein FLJ20602 /DB_XREF = gi: 8923556 /UG = Hs.103808 hypothetical protein FLJ20602 /FL = gb: NM_017896.1" | 218448_at | |
| IGF1R: insulin-like growth factor 1 receptor (LOC3480) SEQ ID NOS: 186 (DNA) and 382 (amino acid) | Consensus includes gb: H05812 /FEA = EST /DB_XREF = gi: 869364 /DB_XREF = est: yl77f04.s1 /CLONE = IMAGE: 44149 /UG = Hs.239176 insulin-like growth factor 1 receptor /FL = gb: NM_000875.2 | 203628_at | signal transduction |
| LOC51315: hypothetical protein LOC51315 (LOC51315) SEQ ID NOS: 187 (DNA) and 383 (amino acid) | "gb: NM_016618.1 /DEF = *Homo sapiens* hypothetical protein (LOC51315), mRNA. /FEA = mRNA /GEN = LOC51315 /PROD = hypothetical protein /DB_XREF = gi: 7706155 /UG = Hs.5721 hypothetical protein /FL = gb: AF208845.1 gb: AF217520.1 gb: NM_016618.1" | 218303_x_at | |
| PBP: prostatic binding protein (LOC5037) SEQ ID NOS: 188 (DNA) and 384 (amino acid) | "gb: NM_002567.1 /DEF = *Homo sapiens* prostatic binding protein (PBP), mRNA. /FEA = mRNA /GEN = PBP /PROD = prostatic binding protein /DB_XREF = gi: 4505620 /UG = Hs.80423 prostatic binding protein /FL = gb: D16111.1 gb: NM_002567.1" | 205353_s_at | |
| KIAA0602: KIAA0602 protein (LOC23241) | "Cluster Incl. AB011174: *Homo sapiens* mRNA for KIAA0602 protein, partial cds /cds = (0,2889) /gb = AB011174 | 34406_at | |

TABLE 2-continued

BIOMARKERS (RESISTANT)

| Unigene title and SEQ ID NO: | Affymetrix Description | Affymetrix Probe Set | Gene Ontology |
|---|---|---|---|
| SEQ ID NOS: 189 (DNA) | /gi = 3043727 /ug = Hs.37656 /len = 3428" | | |
| MYST2: MYST histone acetyltransferase 2 (LOC11143) SEQ ID NOS: 190 (DNA) and 385 (amino acid) | "gb: NM_007067.1 /DEF = *Homo sapiens* histone acetyltransferase (HBOA), mRNA. /FEA = mRNA /GEN = HBOA /PROD = histone acetyltransferase /DB_XREF = gi: 5901961 /UG = Hs.21907 histone acetyltransferase /FL = gb: AF074606.1 gb: AF140360.1 gb: NM_007067.1" | 200049_at | regulation of transcription, DNA-dependent |
| C6orf211: chromosome 6 open reading frame 211 (LOC79624) SEQ ID NOS: 191 (DNA) and 386 (amino acid) | "gb: NM_024573.1 /DEF = *Homo sapiens* hypothetical protein FLJ12910 (FLJ12910), mRNA. /FEA = mRNA /GEN = FLJ12910 /PROD = hypothetical protein FLJ12910 /DB_XREF = gi: 13375745 /UG = Hs.15929 hypothetical protein FLJ12910 /FL = gb: NM_024573.1" | 218195_at | |
| C20orf149: chromosome 20 open reading frame 149 (LOC79144) SEQ ID NOS: 192 (DNA) and 387 (amino acid) | "gb: NM_024299.1 /DEF = *Homo sapiens* hypothetical protein MGC2479 (MGC2479), mRNA. /FEA = mRNA /GEN = MGC2479 /PROD = hypothetical protein MGC2479 /DB_XREF = gi: 13236523 /UG = Hs.79625 hypothetical protein MGC2479 /FL = gb: BC002531.1 gb: NM_024299.1" | 218010_x_at | |
| LLGL2: lethal giant larvae homolog 2 (*Drosophila*) (LOC3993) SEQ ID NOS: 193 (DNA) and 388 (amino acid) | "gb: NM_004524.1 /DEF = *Homo sapiens* lethal giant larvae (*Drosophila*) homolog 2 (LLGL2), mRNA. /FEA = mRNA /GEN = LLGL2 /PROD = lethal giant larvae (*Drosophila*) homolog 2 /DB_XREF = gi: 4758679 /UG = Hs.3123 lethal giant larvae (*Drosophila*) homolog 2 /FL = gb: NM_004524.1" | 203713_s_at | |
| KIAA0882: KIAA0882 protein (LOC23158) SEQ ID NOS: 194 (DNA) and 389 (amino acid) | Consensus includes gb: AI348094 /FEA = EST /DB_XREF = gi: 4085300 /DB_XREF = est: qp61g12.x1 /CLONE = IMAGE: 1927558 /UG = Hs.90419 KIAA0882 protein | 212956_at | |
| CA12: carbonic anhydrase XII (LOC771) SEQ ID NOS: 195 (DNA) and 390 (amino acid) | "gb: BC001012.1 /DEF = *Homo sapiens*, hypothetical protein FLJ20151, clone MGC: 1073, mRNA, complete cds. /FEA = mRNA /PROD = hypothetical protein FLJ20151 /DB_XREF = gi: 12654376 /UG = Hs.279916 hypothetical protein FLJ20151 /FL = gb: BC001012.1 gb: NM_017689.1" | 204508_s_at | |
| SLC2A10: solute carrier family 2 (facilitated glucose transporter), member 10 (LOC81031) SEQ ID NOS: 196 (DNA) and 391 (amino acid) | "gb: NM_030777.1 /DEF = *Homo sapiens* solute carrier family 2 (facilitated glucose transporter), member 10 (SLC2A10), mRNA. /FEA = mRNA /GEN = SLC2A10 /PROD = solute carrier family 2 (facilitated glucosetransporter), member 10 /DB_XREF = gi: 13540546 /FL = gb: NM_030777.1" | 221024_s_at | glucose transport |
| TRIM37: tripartite motif-containing 37 (LOC4591) SEQ ID NOS: 197 (DNA) and 392 (amino acid) | "Consensus includes gb: AK022701.1 /DEF = *Homo sapiens* cDNA FLJ12639 fis, clone NT2RM4001938, highly similar to *Homo sapiens* mRNA for KIAA0898 protein. /FEA = mRNA /DB_XREF = gi: 10434250 /UG = Hs.8164 Mulibrey nanism" | 213009_s_at | |
| AP1G1: adaptor-related protein complex 1, gamma 1 subunit (LOC164) SEQ ID NOS: 198 (DNA) and 393 | "Consensus includes gb: AL050025.1 /DEF = *Homo sapiens* mRNA; cDNA DKFZp564D066 (from clone DKFZp564D066); partial cds. /FEA = mRNA /GEN = DKFZp564D066 /PROD = hypothetical protein /DB_XREF = gi: 4884095 /UG = Hs.5344 | 215867_x_at | endocytosis |

TABLE 2-continued

BIOMARKERS (RESISTANT)

| Unigene title and SEQ ID NO: | Affymetrix Description | Affymetrix Probe Set | Gene Ontology |
|---|---|---|---|
| (amino acid) | adaptor-related protein complex 1, gamma 1 subunit" | | |
| UBL3: ubiquitin-like 3 (LOC5412) SEQ ID NOS: 199 (DNA) and 394 (amino acid) | "gb: NM_007106.1 /DEF = Homo sapiens ubiquitin-like 3 (UBL3), mRNA. /FEA = mRNA /GEN = UBL3 /PROD = ubiquitin-like 3 /DB_XREF = gi: 6005927 /UG = Hs.173091 ubiquitin-like 3 /FL = gb: AF044221.1 gb: AL080177.1 gb: NM_007106.1" | 201535_at | |
| CYB561: cytochrome b-561 (LOC1534) SEQ ID NOS: 200 (DNA) and 395 (amino acid) | "Consensus includes gb: U06715.1 /DEF = Human cytochrome B561, HCYTO B561, mRNA, partial cds. /FEA = mRNA /GEN = B561 /PROD = HCYTO B561 /DB_XREF = gi: 476590 /UG = Hs.153028 cytochrome b-561" | 217200_x_at | secretory vesicle-specific electron transport protein |

Certain biomarkers were of particular interest. Microtubule-associated protein tau was identified as one of the resistance markers, and has been shown to bind at the close site of microtubule where Taxol® binds to. It is believed that Taxol® interferes microtubule and Tau interaction, but Tau's interaction seems more resistant than Taxol® (R. Dye et al., J. Biological Chem., 268, 6847-6850 (1993)). Therefore, this further validates the observation that Tau expressing cells are more resistant to ixabepilone treatment as ixabepilone binds at the same site of Taxol® in tubulin. Another interesting resistance biomarker is estrogen receptor. In general, estrogen-receptor status is predictive of response to hormonal treatments. (J. C. Chang et al., Lancet, 362, 362-369 (2003)). However, it was interesting to observe estrogen receptor as a strong marker for the resistance to ixabepilone. ER has not been previously suggested as a predictive marker of a patient's response to chemotherapy. More interestingly, microtubule associated protein tau is estrogen induced (M. West et al., P. N. A. S. USA, 98, 11462-11467 (2001)). ER and Tau were also found as resistance markers in an analysis of Taxol® (data not provided), and this suggests that Tau and ER both are likely to be the resistance markers for microtubule-stabilizing agents such as ixabepilone and Taxol®.

Several other genes appear promising as potential markers including transporter genes (ATP-binding cassette, sub-family G (WHITE), member 1 and ATP-binding cassette, sub-family A (ABC1), member 3), Midline 1 (C. Berti et al., BMC Cell Biol., February 29; 5(1):9 (2004)), LMP7 and etc. The differential expression patterns of these biomarkers were distinct between the two phenotypes of the cell lines (sensitive and resistant). In addition, their biological functions are involved in drug resistance mechanism or related with microtubule functions. Furthermore, their differential expression patterns observed within tumors support their potential as response markers.

Microtubule-Stabilizing Agents

Agents that affect microtubule-stabilization are well known in the art. These agents have cytotoxic activity against rapidly proliferating cells, such as, tumor cells or other hyperproliferative cellular disease.

In one aspect, the microtubule-stabilizing agent is an epothilone, or analog or derivative thereof. The epothilones, including analogs and derivatives thereof, may be found to exert microtubule-stabilizing effects similar to paclitaxel (Taxol®) and, hence, cytotoxic activity against rapidly proliferating cells, such as, tumor cells or other hyperproliferative cellular disease.

Suitable microtubule-stabilizing agents are disclosed, for example, in the following PCT publications hereby incorporated by reference: WO93/10121; WO98/22461; WO99/02514; WO99/58534; WO00/39276; WO02/14323; WO02/72085; WO02/98868; WO03/070170; WO03/77903; WO03/78411; WO04/80458; WO04/56832; WO04/14919; WO03/92683; WO03/74053; WO03/57217; WO03/22844; WO03/103712; WO03/07924; WO02/74042; WO02/67941; WO01/81342; WO00/66589; WO00/58254; WO99/43320; WO99/42602; WO99/39694; WO99/16416; WO 99/07692; WO99/03848; WO99/01124; and WO 98/25929.

In another aspect, the microtubule-stabilizing agent is ixabepilone. Ixabepilone is a semi-synthetic analog of the natural product epothilone B that binds to tubulin in the same binding site as paclitaxel, but interacts with tubulin differently. (P. Giannakakou et al., P. N. A. S. USA, 97, 2904-2909 (2000)).

In another aspect, the microtubule-stabilizing agent is a taxane. The taxanes are well known in the art and include, for example, paclitaxel (Taxol®) and docetaxel (Taxotere®).

Biomarkers and Biomarker Sets

The invention includes individual biomarkers and biomarker sets having both diagnostic and prognostic value in disease areas in which microtubule-stabilization and/or cytotoxic activity against rapidly proliferating cells, such as, tumor cells or other hyperproliferative cellular disease is of importance, e.g., in cancers or tumors. The biomarker sets comprise a plurality of biomarkers such as, for example, a plurality of the biomarkers provided in Table 1 and Table 2, that highly correlate with resistance or sensitivity to one or more microtubule-stabilizing agents.

The biomarker sets of the invention enable one to predict or reasonably foretell the likely effect of one or more microtubule-stabilizing agents in different biological systems or for cellular responses. The biomarker sets can be used in in vitro assays of microtubule-stabilizing agent response by test cells to predict in vivo outcome. In accordance with the invention, the various biomarker sets described herein, or the combination of these biomarker sets with other biomarkers or markers, can be used, for example, to predict how patients with cancer might respond to therapeutic intervention with one or more microtubule-stabilizing agents.

A biomarker set of cellular gene expression patterns correlating with sensitivity or resistance of cells following exposure of the cells to one or more microtubule-stabilizing agents provides a useful tool for screening one or more tumor samples before treatment with the microtubule-stabilizing agent. The screening allows a prediction of cells of a tumor sample exposed to one or more microtubule-stabilizing agents, based on the expression results of the biomarker set, as to whether or not the tumor, and hence a patient harboring the tumor, will or will not respond to treatment with the microtubule-stabilizing agent.

The biomarker or biomarker set can also be used as described herein for monitoring the progress of disease treatment or therapy in those patients undergoing treatment for a disease involving a microtubule-stabilizing agent.

The biomarkers also serve as targets for the development of therapies for disease treatment. Such targets may be particularly applicable to treatment of breast cancers or tumors. Indeed, because these biomarkers are differentially expressed in sensitive and resistant cells, their expression patterns are correlated with relative intrinsic sensitivity of cells to treatment with microtubule-stabilizing agents. Accordingly, the biomarkers highly expressed in resistant cells may serve as targets for the development of new therapies for the tumors which are resistant to microtubule-stabilizing agents.

The level of biomarker protein and/or mRNA can be determined using methods well known to those skilled in the art. For example, quantification of protein can be carried out using methods such as ELISA, 2-dimensional SDS PAGE, Western blot, immunopreciptation, immunohistochemistry, fluorescence activated cell sorting (FACS), or flow cytometry. Quantification of mRNA can be carried out using methods such as PCR, array hybridization, Northern blot, in-situ hybridization, dot-blot, Taqman, or RNAse protection assay.

Microarrays

The invention also includes specialized microarrays, e.g., oligonucleotide microarrays or cDNA microarrays, comprising one or more biomarkers, showing expression profiles that correlate with either sensitivity or resistance to one or more microtubule-stabilizing agents. Such microarrays can be employed in in vitro assays for assessing the expression level of the biomarkers in the test cells from tumor biopsies, and determining whether these test cells are likely to be resistant or sensitive to microtubule-stabilizing agents. For example, a specialized microarray can be prepared using all the biomarkers, or subsets thereof, as described herein and shown in Table 1 and Table 2. Cells from a tissue or organ biopsy can be isolated and exposed to one or more of the microtubule-stabilizing agents. Following application of nucleic acids isolated from both untreated and treated cells to one or more of the specialized microarrays, the pattern of gene expression of the tested cells can be determined and compared with that of the biomarker pattern from the control panel of cells used to create the biomarker set on the microarray. Based upon the gene expression pattern results from the cells that underwent testing, it can be determined if the cells show a resistant or a sensitive profile of gene expression. Whether or not the tested cells from a tissue or organ biopsy will respond to one or more of the microtubule-stabilizing agents and the course of treatment or therapy can then be determined or evaluated based on the information gleaned from the results of the specialized microarray analysis.

Antibodies

The invention also includes antibodies, including polyclonal or monoclonal, directed against one or more of the polypeptide biomarkers. Such antibodies can be used in a variety of ways, for example, to purify, detect, and target the biomarkers of the invention, including both in vitro and in vivo diagnostic, detection, screening, and/or therapeutic methods.

Kits

The invention also includes kits for determining or predicting whether a patient would be susceptible or resistant to a treatment that comprises one or more microtubule-stabilizing agents. The patient may have a cancer or tumor such as, for example, a breast cancer or tumor. Such kits would be useful in a clinical setting for use in testing a patient's biopsied tumor or other cancer samples, for example, to determine or predict if the patient's tumor or cancer will be resistant or sensitive to a given treatment or therapy with a microtubule-stabilizing agent. The kit comprises a suitable container that comprises: one or more microarrays, e.g., oligonucleotide microarrays or cDNA microarrays, that comprise those biomarkers that correlate with resistance and sensitivity to microtubule-stabilizing agents; one or more microtubule-stabilizing agents for use in testing cells from patient tissue specimens or patient samples; and instructions for use. In addition, kits contemplated by the invention can further include, for example, reagents or materials for monitoring the expression of biomarkers of the invention at the level of mRNA or protein, using other techniques and systems practiced in the art such as, for example, RT-PCR assays, which employ primers designed on the basis of one or more of the biomarkers described herein, immunoassays, such as enzyme linked immunosorbent assays (ELISAs), immunoblotting, e.g., Western blots, or in situ hybridization, and the like, as further described herein.

Application of Biomarkers and Biomarker Sets

The biomarkers and biomarker sets may be used in different applications. Biomarker sets can be built from any combination of biomarkers listed in Table 1 and Table 2 to make predictions about the likely effect of any microtubule-stabilizing agent in different biological systems. The various biomarkers and biomarkers sets described herein can be used, for example, as diagnostic or prognostic indicators in disease management, to predict how patients with cancer might respond to therapeutic intervention with a microtubule-stabilizing agent, and to predict how patients might respond to therapeutic intervention that affects microtubule-stabilization and/or cytotoxic activity against rapidly proliferating cells, such as, tumor cells or other hyperproliferative cellular disease.

The biomarkers have both diagnostic and prognostic value in diseases areas in which microtubule-stabilization and/or cytotoxic activity against rapidly proliferating cells, such as, tumor cells or other hyperproliferative cellular disease is of importance.

In accordance with the invention, cells from a patient tissue sample, e.g., a tumor or cancer biopsy, can be assayed to determine the expression pattern of one or more biomarkers prior to treatment with one or more microtubule-stabilizing agents. In one aspect, the tumor or cancer is breast cancer. Success or failure of a treatment can be determined based on the biomarker expression pattern of the cells from the test tissue (test cells), e.g., tumor or cancer biopsy, as being relatively similar or different from the expression pattern of a control set of the one or more biomarkers. Thus, if the test cells show a biomarker expression profile which corresponds to that of the biomarkers in the control panel of cells which are sensitive to the microtubule-stabilizing agent, it is highly likely or predicted that the individual's cancer or tumor will respond favorably to treatment with the microtubule-stabilizing agent. By contrast, if the test cells show a biomarker expression pattern corresponding to that of the biomarkers of the control panel of cells which are resistant to the microtubule-stabilizing agent, it is highly likely or predicted that the individual's cancer or tumor will not respond to treatment with the microtubule-stabilizing agent.

The invention also provides a method of monitoring the treatment of a patient having a disease treatable by one or more microtubule-stabilizing agents. The isolated test cells from the patient's tissue sample, e.g., a tumor biopsy or tumor sample, can be assayed to determine the expression pattern of one or more biomarkers before and after exposure to a microtubule-stabilizing agent. The resulting biomarker expression profile of the test cells before and after treatment is compared with that of one or more biomarkers as described and shown herein to be highly expressed in the control panel of cells that are either resistant or sensitive to a microtubule-stabilizing agent. Thus, if a patient's response is sensitive to treatment by a microtubule-stabilizing agent, based on correlation of the expression profile of the one or biomarkers, the patient's treatment prognosis can be qualified as favorable and treatment can continue. Also, if, after treatment with a microtubule-stabilizing agent, the test cells don't show a change in the biomarker expression profile corresponding to the control panel of cells that are sensitive to the microtubule-stabilizing agent, it can serve as an indicator that the current treatment should be modified, changed, or even discontinued. This monitoring process can indicate success or failure of a patient's treatment with a microtubule-stabilizing agent and such monitoring processes can be repeated as necessary or desired.

The biomarkers of the invention can be used to predict an outcome prior to having any knowledge about a biological system. Essentially, a biomarker can be considered to be a statistical tool. Biomarkers are useful in predicting the phenotype that is used to classify the biological system.

Although the complete function of all of the biomarkers are not currently known, some of the biomarkers are likely to be directly or indirectly involved in microtubule-stabilization and/or cytotoxic activity against rapidly proliferating cells. In addition, some of the biomarkers may function in metabolic or other resistance pathways specific to the microtubule-stabilizing agents tested. Notwithstanding, knowledge about the function of the biomarkers is not a requisite for determining the accuracy of a biomarker according to the practice of the invention.

EXAMPLES

Example 1

Identification of Biomarkers

Methods

Cell Lines and Cytotoxicity Assay 23 breast cancer cell lines were assayed for their sensitivity to ixabepilone. Each cell line was exposed to ixabepilone for 72 hours, and growth inhibition was assessed by the CellTiter 96® Aqueous Non-Radioactive Cell proliferation Assay (Promega) for $IC_{50}$ measurements. Then, the concentration of the ixabepilone required for 50% growth inhibition was calculated as the $IC_{50}$. For each experimental condition, at least triplicate measurements were carried out for each cell line. The 23 cell lines were assayed for their $IC_{50}$ measurements twice, and these two separate $IC_{50}$ data sets were used for the following analysis.

Training Set Selection

For analysis, training cell lines were chosen in the following manner. The 23 cell lines were assigned into the classes "sensitive" or "resistant" using $IC_{50}$ values; $\log(IC_{50})$ values were normalized based on the mean and the standard deviation (SD) across the 23 cell lines for each $IC_{50}$ data set. (J. E. Staunton et al., P. N. A. S. USA. 98, 10787-10792 (2001)) The cell lines with the normalized $\log(IC_{50})$ below the mean of $\log(IC_{50})$s were classified as sensitive and above as resistant. Subsequently, classification of the cell lines were compared in two separate experiments and 18 cell lines that exhibited consistent $IC_{50}$ and classification were chosen as a training set for subsequent marker analysis. Five cell lines with inconsistent $IC_{50}$ and classification were considered to be intermediate and were eliminated from the analysis.

RNA Extraction and Gene Expression Data

The 23 breast cancer cell lines were grown to 50-70% confluent in RPMI media with FBS 10% at 37° C. and 5% $CO_2$. RNA was isolated using the RNeasy Mini kit (Qiagen) according to the manufacturer's instructions. 10 ug of total RNA was used to prepare biotinylated cRNA targets as described in Affymetrix protocol. Targets were hybridized to Affymetrix high-density HU133 A and B set that consist of 44,000 probe sets containing ~32,000 genes. The chips were washed and stained using recommended procedures for GeneChip®. Expression values were calculated and scaled to 1500 by using Affymetrix GeneChip® software.

k-Nearest Neighbors (KNN) Analysis

GeneCluster software was used to find a set of marker genes. First, genes with greater than 100 average difference were filtered. Then, genes were excluded if they varied by less than 2-fold and 1000 average difference change across 18 training cell lines. Subsequently, intensity units across the cell lines for each gene were normalized to the mean and variance. The genes were ranked according to the correlation between their expression level, and the sensitivity and resistance profile of the training cell lines. A marker gene selection process was carried out by KNN algorithm which fed only the genes with higher correlation with the target class. The KNN algorithm sets the class of the data point to the majority class appearing in the k closest training set samples. This marker selection is done by sorting the genes according to the signal-to-noise statistics, $[\mu 1(g)-\mu 2(g)]/[\sigma 1(g)+\sigma 2(g)]$, described as the correlation function where $[\mu 1(g), \mu 2(g)]$ and $[\sigma 1(g), \sigma 2(g)]$ denote the means and SDs of the expression levels of gene g for the samples in class 1 and class 2, respectively. The magnitude of correlation values indicates the strength of the correlation between gene expression and class distinction.

Leave-One-Out Cross-Validation Analysis and Random Classification

Predictors with 1-250 genes were used for cross-validation of the training set. For each predictor, cross-validation was performed with the entire training set; one cell line was removed, the classifier was trained on the remaining cell lines and then tested for its ability to classify the withheld cell line. This procedure was repeated for each cell line in the training set. For random classification analysis, GeneCluster was used to generate random class vectors and calculate error rates.

Clustering and Tree View

Gene expression data were analyzed by the software Cluster and TreeView.

Breast Tumors and Gene Expression Data

RNAs extracted from 175 breast tumors resected at the surgery were obtained from the Karolinska Institute (Stockholm, Sweden). These RNA samples were profiled using Affymetrix Human U133 sets and their gene expression data were used for the analysis.

Results

Drug sensitivity data (IC$_{50}$) was used as a template for determining the phenotype of the cell lines as resistant or sensitive. Initially, two separate IC$_{50}$ data sets were generated for 23 breast cancer cell lines. As a first step for the analysis, the log(IC$_{50}$) value for each cell line was calculated and normalized using the mean of log(IC$_{50}$)s and SD across the cell lines (J. E. Staunton et al., P. N. A. S. USA. 98, 10787-10792 (2001)) in each IC$_{50}$ data panel. Then the cell lines were divided into two classes using the following method; the normalized log(IC$_{50}$)s above the mean are defined as resistant and below as sensitive (FIG. 1). After comparing the classification of the cell lines in the two data sets, 18 cell lines that displayed the consistent classification and IC$_{50}$ values in two separate experiments were selected and utilized for marker selection.

Figure 2:
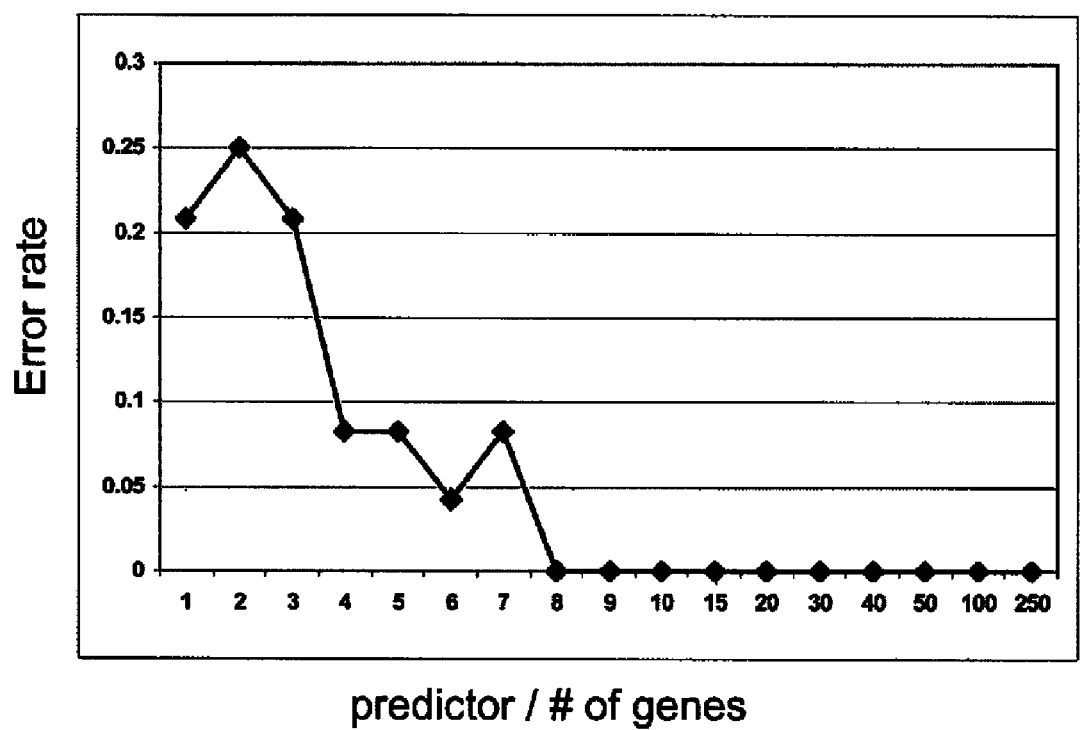
FIG. 2 illustrates the error rates generated from each classifier identified. From the GeneCluster analysis, classifiers containing up to 250 genes were determined. Each predictor identified was evaluated with the error rate calculated through the leave-one out cross validation.
Figure 3:
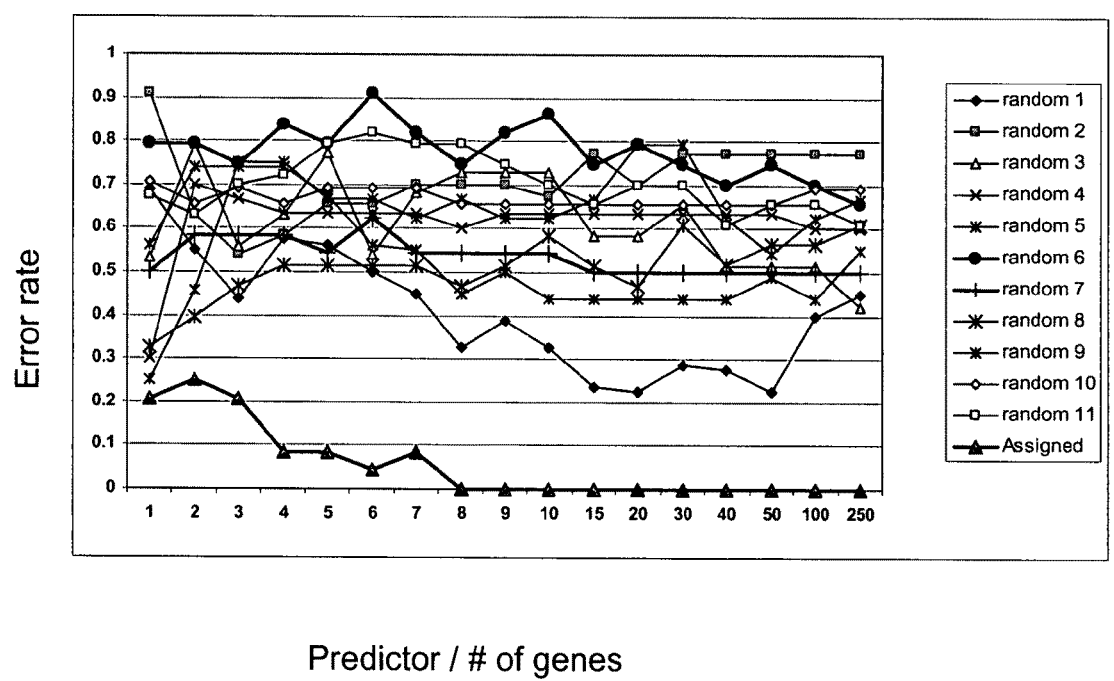
FIG. 3 illustrates the error rate calculation on random permutation. Error rates generated from several examples of random classification (random 1-11) using the software GeneCluster are plotted against the predictor sets containing up to 250 genes. As shown in the plot, the error rate calculated based on the $IC_{50}$-based classification is significantly lower than the error rates based on the random classification.

Subsequently, the gene expression data of the 18 cell lines were analyzed to identify genes that were highly correlated with observed phenotype defined as sensitive or resistant. From the GeneCluster analysis, classifiers that consisted of up to 250 correlated genes were selected and tested through leave-one out cross validation; by holding back one cell line, training on the remaining cell lines, predicting the class of the withheld cell line, and repeating this cycle for each cell line in the training set. Each gene was ranked according to the correlation in the training set between its expression level and the sensitivity-resistance class distinction. Each classifier identified from the analysis was evaluated with the error rate as shown in the FIG. 2. In order to assess whether or not the classifiers can be observed by chance, the error rates calculated from random classification were examined. Shown as an example in FIG. 3, error rates generated from random classifications were significantly higher than that from IC$_{50}$-based classification.

From the GeneCluster analysis, 200 genes (Tables 1 and 2) were identified whose expression levels were highly correlated with the sensitivity-resistance class distinction based on the KNN analysis and the T-test. Among these genes, the 50 marker candidates most closely correlated with sensitivity-resistance class distinction (first 25 sensitive markers of Table 1 and first 25 resistant markers of Table 2) were selected for further analysis.

Figure 4:
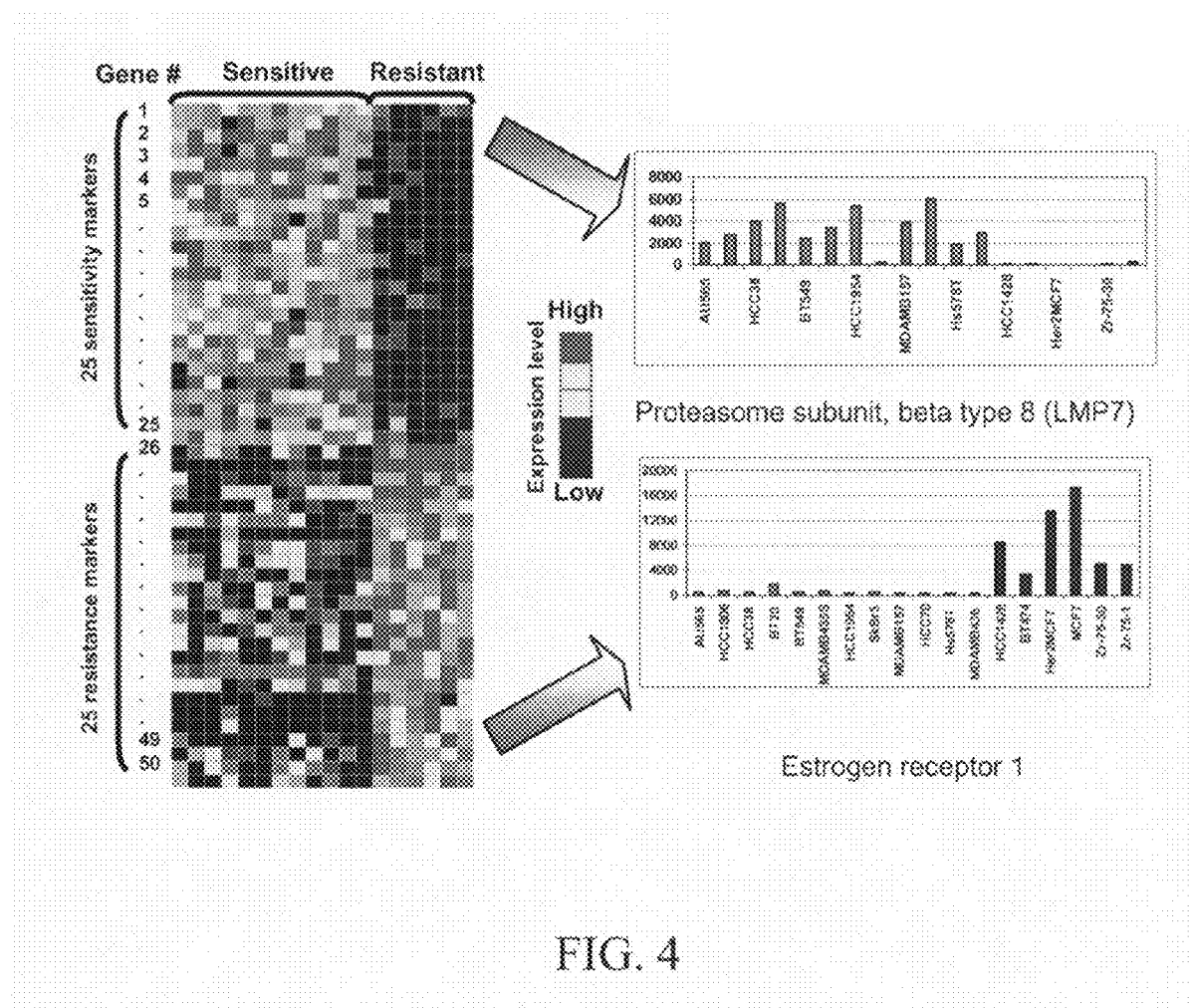
FIG. 4 illustrates the top 50 genes correlated with sensitivity for ixabepilone. The red and blue matrix represents the normalized expression patterns for each gene across the cell lines (brightest red indicates highest relative expression, darkest blue indicates lowest relative expression).

As shown in FIG. 4, these 50 genes showed distinct expression patterns between sensitive and resistant cell lines. For example, the top 25 markers correlated with sensitivity (one of which was Proteasome subunit, beta type 8 (LMP7)) as shown in FIG. 4 were highly expressed (shown in red) in sensitive cell lines, but at a lower level (shown in blue) in the resistant cell lines. In contrast, the top 25 markers correlated with resistance showed the opposite expression pattern as these genes were highly expressed in the resistant cell lines, but at a lower level in the sensitive cell lines.

Figure 5:
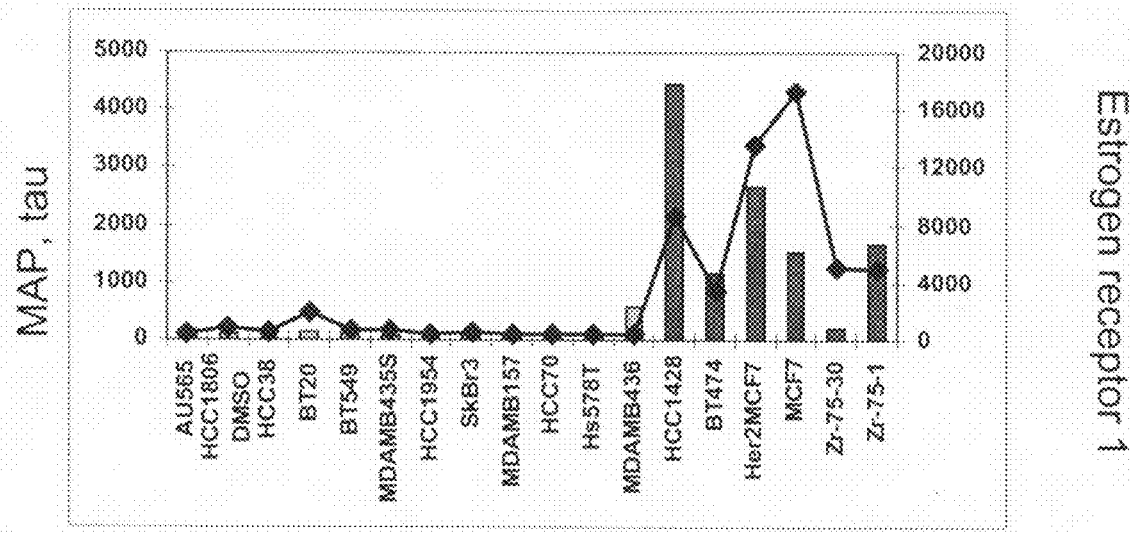
FIG. 5 illustrates gene expression level of microtubule associated protein, tau and estrogen receptor (also referred to herein as estrogen receptor 1, ER, and ER1). In order to explore the relationship between Tau and ER, gene expression levels of the two are plotted for each cell line. Tau expression levels are shown as a bar, and ER as a line.

Among 200 genes identified, it is interesting to find estrogen receptor (ER) as one of the resistance markers. As shown in FIG. 4, ER expression levels were highly correlated with the resistance to ixabepilone. ER was highly expressed in the resistant cell lines, but its expression was very low in the sensitive cell lines. Although the resistance mechanism of ER is not obvious, the data suggests that ER might be involved in drug resistance associated with microtubule stabilizing agents. In fact, ER was also found as a resistance marker in our analysis of paclitaxel (data not shown). In addition to ER, a microtubule-associated protein, tau (Tau), was also identified as one of the resistance markers. This protein has been proposed to bind close to the Taxol® binding site on β-tubulin and stabilize microtubules in a similar way to Taxol® (S. Kar et al., EMBO J., 22, 70-77. (2003)). Therefore, Tau is likely to affect the Taxol® bound to microtubules and, presumably, ixabepilone in a similar way since ixabepilone binds at the same site as paclitaxel on β-tubulin. Interestingly, Tau is estrogen induced (M. West et al., P. N. A. S. USA, 98, 11462-11467 (2001)). Evidently, they seem to be co-regulated as shown in a plot of Tau expression level against ER (FIG. 5). Their correlation coefficient value is 0.7.

Among the sensitivity markers identified, LMP7 is particularly interesting because it appears to be connected to Tau's function. In general, the proteasome is a multicatalytic proteinase complex responsible for the degradation of most intracellular proteins, including proteins crucial to cell cycle regulation and programmed cell death, or apoptosis (P. Voorhees et al., Clin. Cancer Res., 9, 6316-6325 (2003)). Among many proteins processed by the proteasome, Tau is degraded by the 20S proteasome in vitro in an ubiquitin-independent manner (D. David et al., J. of Neurochemistry, 83, 176-185 (2002)). This supports LMP7 as one of the sensitivity markers because LMP7 presumably facilitates interaction between ixabepilone and microtubules by degrading Tau and making ixabepilone more accessible to the microtubules.

One type of drug resistance mechanism is based on the function of a group of transporter proteins, able to prevent the intracellular accumulation of anticancer drugs by an efflux mechanisms (F. Leonessa et al., Endocr. Relat. Cancer., 10, 43-73 (2003)). Several transporter genes were identified as potential resistance markers as they were highly expressed in the resistant cell lines. These genes include ATP-binding cassette, sub-family G (WHITE), member 1 and ATP-binding cassette, sub-family A (ABC1), member 3. They are ATP dependent transporters which may be involved in lipid transport, and act as an efflux pump for chemotherapeutics drugs respectively (M. Gottesman et al., Nat. Rev. Cancer., January; 2(1):48-58 (2002)).

In addition, genes implied in microtubule functions are particularly interesting since ixabepilone is a microtubule-stabilizing agents. Microtubules are essential components of the cytoskeleton and involved in cell motility and transport, and maintenance of cell shape. The dynamic nature of a microtubule whose ability to polymerize and depolymerize, is essential for the segregation of chromosomes during mitosis (C. Bode et al., Biochemistry, 41, 3870-3874 (2002)). Therefore, marker genes such as midline 1 (C. Berti et al., BMC Cell Biol., February 29; 5(1):9 (2004)) and annexin A1 (L. C. Alldridge et al., Exp. Cell Res., October 15; 290(1):93-107 (2003)) that are implied in those functions can be involved in the mechanism of drug resistance. The biomarkers are categorized by their biological functions in Tables 1 and 2.

Figure 6:
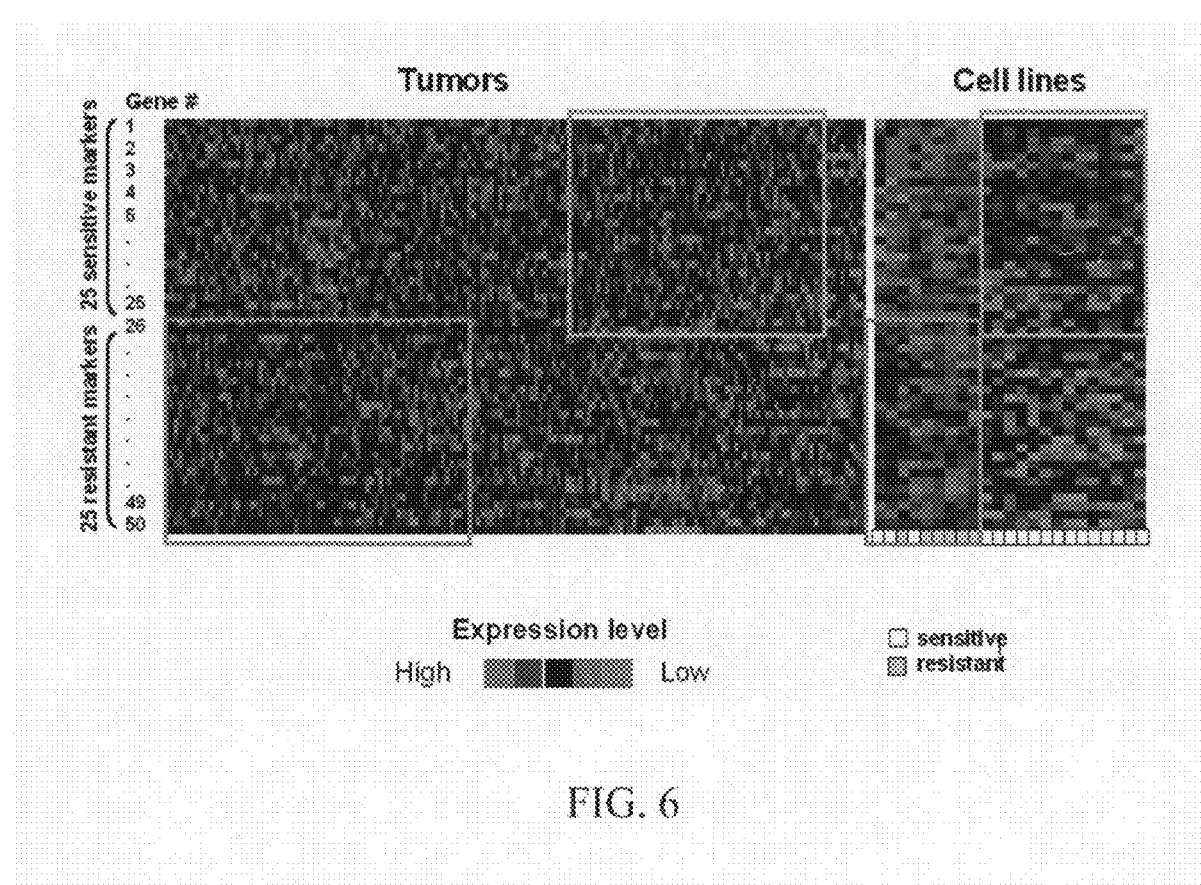
FIG. 6 illustrates gene expression patterns of top 50 genes in 175 primary breast tumors. The red and green matrix represents the normalized expression patterns for each gene across the 175 primary breast tumors (brightest red indicates highest relative expression, green indicates lowest relative expression). A subset of tumors in a blue box shows relative high expression of the top 25 markers which expressed highly in the sensitive cell lines. On the other hand, the tumors in a magenta box show relatively high expression of the 25 genes expressed at elevated levels in the resistant cell lines.
Figure 7:
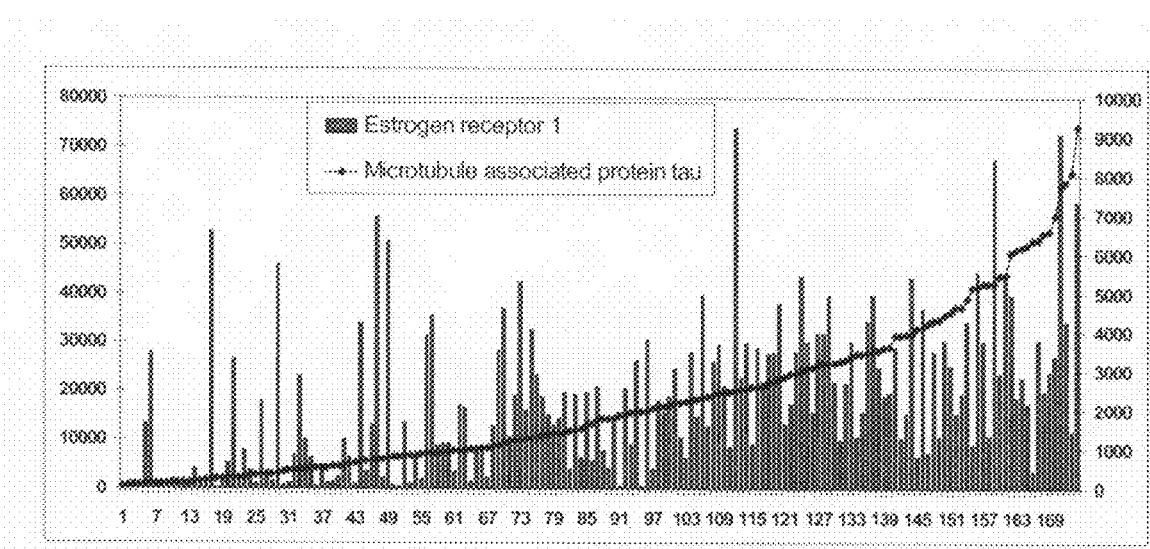
FIG. 7 illustrates MAP tau and ER expression in breast tumors. In order to see the expression patterns of Tau and ER within tumors, their expression levels are plotted together. Tau is shown as a line, and ER as a bar. Tumors are arranged in an increasing order of Tau expression level. There seems to be a subset of tumors that express these genes highly, which suggest these are non-responders for ixabepilone.

To study the use of these genes as response prediction markers in vivo, the expression pattern of these 50 genes in 175 breast cancer biopsies obtained from the Karolinska Institute was examined. The 50 genes were used to cluster the expression patterns of tumors. As shown in FIG. 6, these tumors were found to show patterns of expression that allowed sub-classification of these tumors into distinct groups as seen in the cell line study. Among many genes, Tau and ER were examined in tumors which were identified as resistance markers from cell lines. As shown in the FIG. 7, there is a trend in which Tau and ER seem to correlate as seen in the cell line study. In fact, both genes are highly expressed in a subset of tumors. These tumors are presumed to be non-responders for ixabepilone treatment.

Example 2

Further Evaluation of ER and Tau Biomarkers

Figure 9:
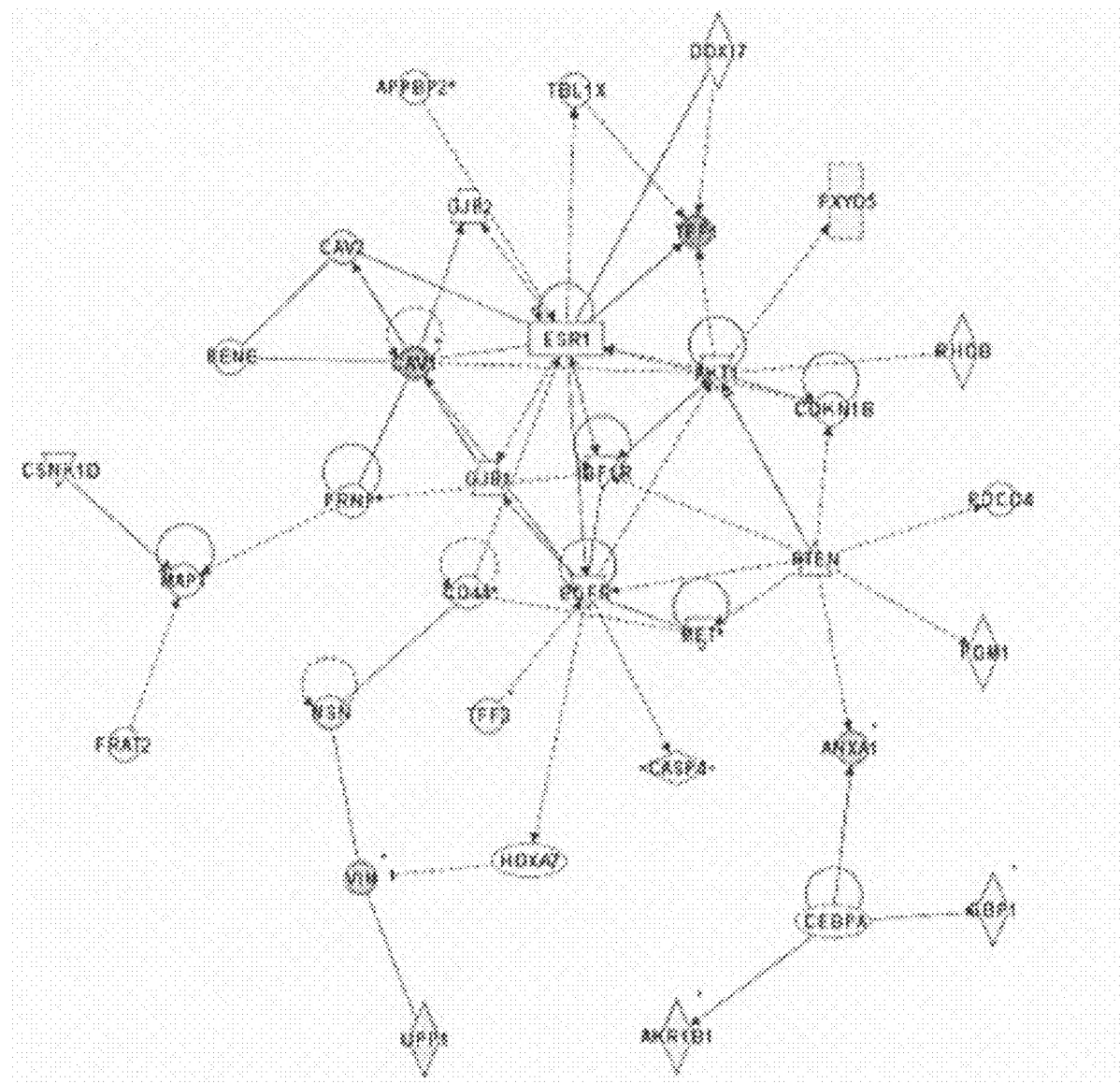
FIG. 9 illustrates the most implicated ER network and shows the functional connectivity between ER and Tau.
Figure 10:
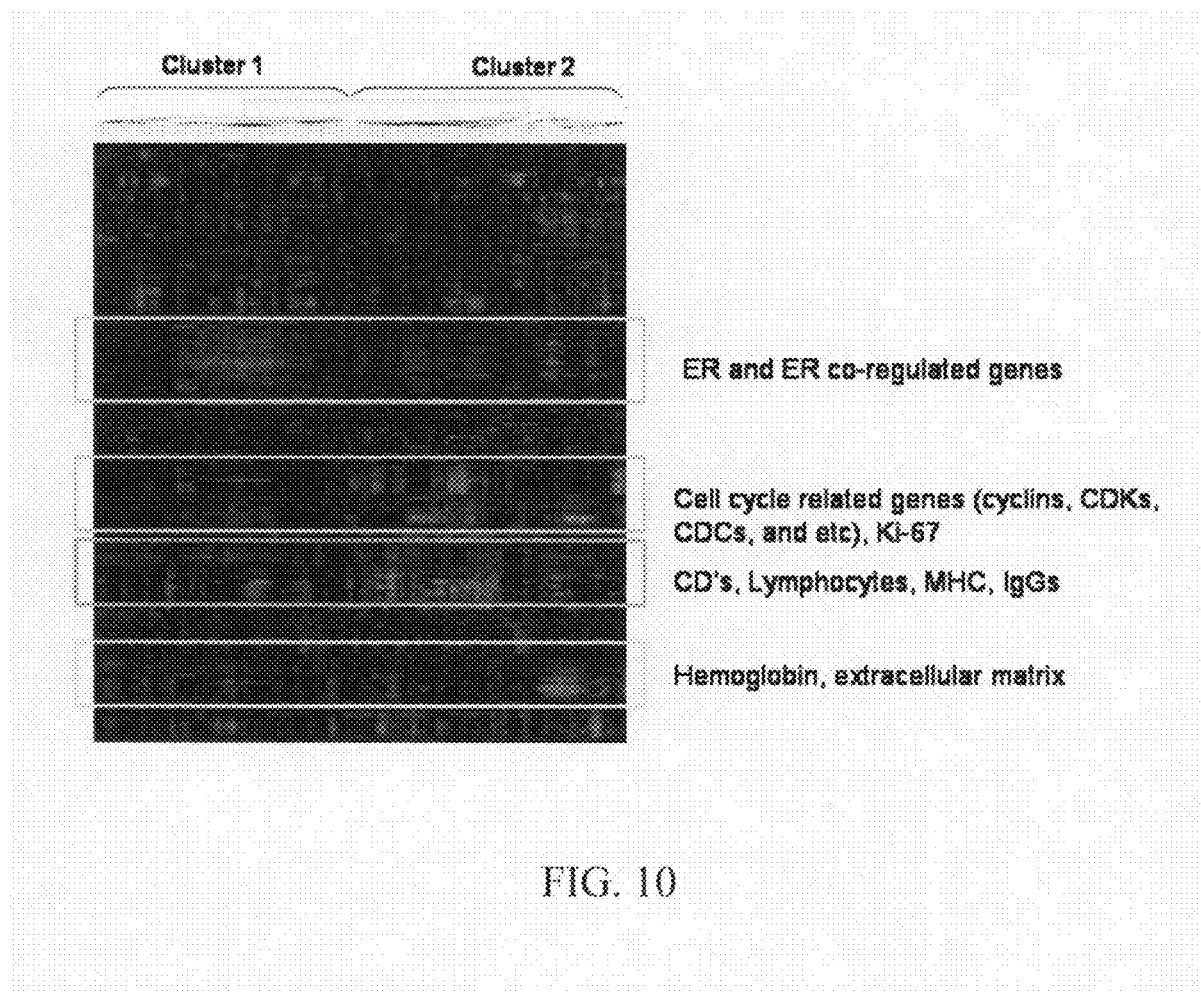
FIG. 10 illustrates molecular intrinsic profiles of 134 patient tumors. A hierarchical clustering analysis was performed using about 9800 genes after eliminating low expressed and low variance genes. Row, gene; column, tumor. The tumors were classified into two major clusters and, interestingly, the majority of the samples from three Russian sites were clustered in the first cluster.

Estrogen receptor (ER) and tau (Tau) were identified as biomarkers since their expression patterns were highly correlated with resistance to ixabepilone. In addition, it was found that the ER pathway was the most implicated biological network for resistance to ixabepilone based on the pathway analysis using preclinical candidate markers (FIGS. 9 and 10). Interestingly, Tau was recently identified as the gene most correlated with pathological complete response for T/FAC neoadjuvant treatment in breast cancer patients (M. Ayers et al, J. Clin. Oncol., 22(12):2284-93 (2004); R. Rouzier et al., P.N.A.S., June 7; 102(23):8315-20 (2005)). Following this report, our preclinical study on paclitaxel supported the clinical findings of Tau as a novel mediator of paclitaxel sensitivity (P. Wagner et al., Cell Cycle, September; 4(9):1149-52 (2005)). ER and Tau were evaluated for their predictability of response to ixabepilone in CA163-080 trial.

Methods

CA163-080 Study

CA163-080 is an exploratory genomic phase II study that was conducted in breast cancer patients who received ixabepilone as a neoadjuvant treatment. The primary objective of this study was to identify predictive markers of response to ixabepilone through gene expression profiling of pre-treatment breast cancer biopsies. Patients with invasive stage IIA-IIIB breast adenocarcinoma (tumor size≧3 cm diameter) received 40 mg/m² ixabepilone as a 3-hour infusion on Day 1 for up to four 21-day cycles, followed by surgery within 3-4 weeks of completion of chemotherapy. A total of 164 patients were enrolled in this study. Biopsies for gene expression analysis were obtained both pre- and post-treatment. Upon isolation of biopsies from the patients, samples were either snap frozen in liquid nitrogen or placed into RNAlater solution overnight, followed by removal from the RNAlater solution. All samples were kept at −70° C. until use.

Evaluation of Pathological Response

Pathological response was assessed using the Sataloff classification system (D. Sataloff et al., J. Am. Coll. Surg., 180 (3):297-306 (1995)) and used as an end point for the pharmacogenomic analysis. The pathologic response was evaluated in the primary tumor site at the end of treatment and prior to surgery by assessing histologic changes compared with baseline as following: At the primary tumor site, cellular modifications were evaluated in both the infiltrating tumoral component and in the possible ductal component, to determine viable residual infiltrating component (% of total tumoral mass); residual ductal component (% of total tumoral mass); the mitotic index. Pathologic Complete Response (pCR) in the breast only was defined as T-A, Total or near total therapeutic effect in primary site. Based on this criteria, responders included patients with pCR while non-responders included patients who failed to demonstrate pCR. The response rate was defined as the number of responders divided by the number of treated patients.

Gene Expression Profiling

Total RNA was isolated using the RNeasy Mini kit (Qiagen) according to the manufacturer's instructions by Karolinska Institute (Stockholm, Sweden). A total of 134 patients with more than 1 µg of total RNA with good quality were included in the data set for the final genomic analysis. Samples were profiled in a randomized order by batches to minimize the experimental bias. Each batch consisted of about 15 subject samples and 2 experimental controls using RNA extracted from HeLa cells. The expression profiling was done following a complete randomization with an effort to balance the number of samples from two tissue collection procedures (RNAlater and liquid nitrogen), two mRNA preparation methods (standard and DNA supernatants), tissue collection sites, and time of RNA sample preparation within in each batch. The mRNA samples from each subject was processed with HG-U133A 2.0 GeneChip® arrays on the Affymetrix platform and quantitated with GeneChip® Operating Software (GCOS) V1.0 (Affymetrix). The HG-U133A 2.0 GeneChip® array consists of about 22,276 probe sets, each containing about 15 perfect match and corresponding mismatch 25 mer oligonucleotide probes from specific gene sequences.

Gene Expression Data Processing

The gene expression data were transformed using base two logarithm. The Robust Multichip Average (RMA) method (C. Clopper et al., Biometrika, 26:404-13 (1934)) was used to normalize the raw expression data. The gene expression measures of each gene were centered at zero and rescaled to have a 1-unit standard deviation.

Stromal Effects in Tumor Biopsies

A hierarchical clustering analysis was performed in order to examine molecular profiles of tumor biopsies (FIG. 10). Among the two highest level clusters, the tumor samples from three Russian sites (site numbers 16, 24 and 25) were mostly clustered in the first cluster (Fisher's exact test, p-value <0.01). It appeared that genes implied in lymphocyte functions such as MHC, CD antigen, and IgG were enriched in this cluster. Therefore, this led to the concern that the tumors from the three Russian sites contained more stroma in the biopsies than other sites, thus contaminating the RNA samples with respect to gene expression for tumor tissue alone. In addition, the mean tumor size from the three Russian sites (16, 24 and 25) was larger than that for the other sites (mean 5.43 vs. mean 4.55, t-test p-value=0.022). Moreover, the pCR response rate was lower than that of the other sites (pCR 19.8% v.s. 17.2%, chi-squared p-value=0.73). This suggested that tumors from the three Russian sites were distinct from the others. Thus, a subgroup analysis excluding the three Russian sites was also performed.

Statistical Analysis

Logistic regression (F. Hsieh et al., Stat. Med., 17(14): 1623-34 (1998)) was used to explore the relationships between the expression of genes and response to ixabepilone. The following model was fitted for each gene separately:

$$\log\left(\frac{Pr(Y=1\mid X)}{1-Pr(Y=1\mid X)}\right) = b_0 + b_1 X$$

where Y=1 represents a responder and X is the gene expression measure. For each gene, the probability from a two-tailed Score test of whether the estimate of $b_1=0$ was used to rank the most interesting genes for further investigation. $e^{b_1}$ is the odds ratio of being a non-responder for a one unit increase in gene expression relative to the average expression for the sample of subjects. Odds ratios and 95% confidence limits were reported.

Subjects were randomly assigned to the equal sized training set (n=67) or the test set (n=67), for responders and non-responders groups separately. The gene expression of ER and Tau were considered as potential predictors for response. Single logistic regression (SLR) was used to build the predictive model based on the training set, and the model performance was assessed on the test set. The prediction error, sensitivity, specificity, PPV (positive predictive value), and NPV (negative predictive value) as well as their 95% confidence intervals of the SLR model were estimated.

Results

Estrogen Receptor (ER) and Tau

For ER, patients whose predicted probability of being responders was greater than 0.3 were classified as responders.

The ER prognostic sensitivity, specificity, PPV, NPV, and their 95% confidence intervals of the SLR model are 0.64 (0.35, 0.85), 0.79 (0.66, 0.87), 0.37 (0.19, 0.59), and 0.92 (0.80, 0.97), respectively. For Tau, patients whose predicted probability of being responders was greater than 0.25 were classified as responders. The Tau prognostic sensitivity, specificity, PPV, NPV, and their 95% confidence intervals of the SLR model are 0.55 (0.28, 0.79), 0.73 (0.60, 0.83), 0.29 (0.14, 0.50), and 0.89 (0.77, 0.95), respectively.

Estrogen Receptor (ER) and Tau without Russian Sites 16, 24 and 25

For ER and Tau separately as SLR predictors, patients whose predicted probability of being responders was greater than 0.5 were classified as responders. The estrogen receptor 1 prognostic sensitivity, specificity, PPV, NPV and their 95% confidence intervals of the SLR model are 0.67 (0.35, 0.88), 0.83 (0.69, 0.92), 0.46 (0.23, 0.71), and 0.92 (0.79, 0.97), respectively. The Tau prognostic sensitivity, specificity, PPV, NPV, and their 95% confidence intervals of the SLR model are 0.44 (0.19, 0.73), 0.88 (0.75, 0.95), 0.44 (0.19, 0.73), and 0.88 (0.75, 0.95), respectively.

Conclusion/Discussion

A total of 164 patients were enrolled in CA163-080 study. The quality and quantity of RNA samples obtained from pre-treatment biopsies was fairly good as 134 patients (85%) had RNA samples with >1 µg good quality which did not require additional amplification for gene expression profiling. Stromal contamination in the tumor biopsies was raised as a potential problem for the analysis. It appeared that the three Russian sites 16, 24 and 25 might have more stromal tissues in the samples compared to others based on the hierarchical clustering analysis. In addition, the tumors from these three Russian sites were larger than others at baseline. Although further analysis is needed to confirm this hypothesis, it raised an important issue for analyzing clinical samples that are inherently heterogeneous.

Among preclinical candidate markers, ER and Tau were examined in CA163-080 for their predictability. In our preclinical work, ER and Tau had been identified as biomarkers since their expression patterns were highly correlated with resistance to ixabepilone. In CA163-080, ER predicted well for pCR whether or not the three Russian sites were included in the analysis. However, the highest PPV was obtained when these sites were excluded. In another study finding predictive markers of response to combination chemotherapy with paclitaxel, 5-Fluorouracil, adriamycin and cyclophosphamide, the ER regulated gene Tau was identified as the best predictor of response (M. Ayers et al., J. Clin. Oncol., 22(12): 2284-93 (2004)). Work done by this group has also demonstrated in vitro that knocking down Tau levels using small interfering RNA (siRNA) increases the sensitivity of breast cancer cell lines to paclitaxel treatment (R. Rouzier et al., P.N.A.S., June 7; 102(23):8315-20 (2005)). The proposed mechanism is that high levels of Tau inhibit binding of paclitaxel to the taxane binding site on β-tubulin. Tau gene expression was therefore also examined for ability to predict response to ixabepilone. The PPV (0.44) with this gene was similar to that for ER (0.46) in the subset excluding the 3 Russian sites.

Thus, ER and Tau demonstrated their utility as a predictors for response to ixabepilone and can be used as biomarkers for identifying the pCR responders to ixabepilone.

Example 3

Production of Antibodies Against the Biomarkers

Antibodies against the biomarkers can be prepared by a variety of methods. For example, cells expressing a biomarker polypeptide can be administered to an animal to induce the production of sera containing polyclonal antibodies directed to the expressed polypeptides. In one aspect, the biomarker protein is prepared and isolated or otherwise purified to render it substantially free of natural contaminants, using techniques commonly practiced in the art. Such a preparation is then introduced into an animal in order to produce polyclonal antisera of greater specific activity for the expressed and isolated polypeptide.

In one aspect, the antibodies of the invention are monoclonal antibodies (or protein binding fragments thereof). Cells expressing the biomarker polypeptide can be cultured in any suitable tissue culture medium, however, it is preferable to culture cells in Earle's modified Eagle's medium supplemented to contain 10% fetal bovine serum (inactivated at about 56° C.), and supplemented to contain about 10 g/l nonessential amino acids, about 1,00 U/ml penicillin, and about 100 µg/ml streptomycin.

The splenocytes of immunized (and boosted) mice can be extracted and fused with a suitable myeloma cell line. Any suitable myeloma cell line can be employed in accordance with the invention, however, it is preferable to employ the parent myeloma cell line (SP2/0), available from the ATCC (Manassas, Va.). After fusion, the resulting hybridoma cells are selectively maintained in HAT medium, and then cloned by limiting dilution as described by Wands et al. (1981, Gastroenterology, 80:225-232). The hybridoma cells obtained through such a selection are then assayed to identify those cell clones that secrete antibodies capable of binding to the polypeptide immunogen, or a portion thereof.

Alternatively, additional antibodies capable of binding to the biomarker polypeptide can be produced in a two-step procedure using anti-idiotypic antibodies. Such a method makes use of the fact that antibodies are themselves antigens and, therefore, it is possible to obtain an antibody that binds to a second antibody. In accordance with this method, protein specific antibodies can be used to immunize an animal, preferably a mouse. The splenocytes of such an immunized animal are then used to produce hybridoma cells, and the hybridoma cells are screened to identify clones that produce an antibody whose ability to bind to the protein-specific antibody can be blocked by the polypeptide. Such antibodies comprise anti-idiotypic antibodies to the protein-specific antibody and can be used to immunize an animal to induce the formation of further protein-specific antibodies.

Example 4

Immunofluorescence Assays

The following immunofluorescence protocol may be used, for example, to verify biomarker protein expression on cells or, for example, to check for the presence of one or more antibodies that bind biomarkers expressed on the surface of cells. Briefly, Lab-Tek II chamber slides are coated overnight at 4° C. with 10 micrograms/milliliter (µg/ml) of bovine collagen Type II in DPBS containing calcium and magnesium (DPBS++). The slides are then washed twice with cold DPBS++ and seeded with 8000 CHO—CCR5 or CHO pC4 transfected cells in a total volume of 125 g and incubated at 37° C. in the presence of 95% oxygen/5% carbon dioxide.

The culture medium is gently removed by aspiration and the adherent cells are washed twice with DPBS++ at ambient temperature. The slides are blocked with DPBS++ containing 0.2% BSA (blocker) at 0-4° C. for one hour. The blocking solution is gently removed by aspiration, and 125 µl of antibody containing solution (an antibody containing solution may be, for example, a hybridoma culture supernatant which is usually used undiluted, or serum/plasma which is usually diluted, e.g., a dilution of about 1/100 dilution). The slides are incubated for 1 hour at 0-4° C. Antibody solutions are then gently removed by aspiration and the cells are washed five times with 400 µl of ice cold blocking solution. Next, 125 µl of 1 µg/ml rhodamine labeled secondary antibody (e.g., anti-human IgG) in blocker solution is added to the cells. Again, cells are incubated for 1 hour at 0-4° C.

The secondary antibody solution is then gently removed by aspiration and the cells are washed three times with 400 µl of ice cold blocking solution, and five times with cold DPBS++.

The cells are then fixed with 125 µl of 3.7% formaldehyde in DPBS++ for 15 minutes at ambient temperature. Thereafter, the cells are washed five times with 400 µl of DPBS++ at ambient temperature. Finally, the cells are mounted in 50% aqueous glycerol and viewed in a fluorescence microscope using rhodamine filters.

Although the invention has been described in some detail by way of illustration and example for purposes of clarity and understanding, it will be apparent that certain changes and modifications may be practiced within the scope of the appended claims.

SEQUENCE LISTING (395 sequences)

SEQ ID NO: 1 - DNA, 1880 bp, Homo sapiens
cgccgccccgctgccccgaacgcgggccatacgcagcctccttggagtgacgggccgaccccggacgaccccggccacggacagacccgggacgaccccggccggggcgcgcctcctgcgggcgggcgggcggcggggctggggagcccttggcgggggcatgcgtgcgacatggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcacctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgacccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttctcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactctaaaaaaaaaaaaaaa

SEQ ID NO: 2 - DNA, 1539 bp, Homo sapiens
gctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgag

SEQ ID NO: 3 - DNA, 890 bp, Homo sapiens
ctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgcc

SEQ ID NO: 4 - DNA, 2855 bp, Homo sapiens
gagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaaaaaaaaaaaaaaaaaaaaaa

SEQ ID NO: 5 - DNA, 1578 bp, Homo sapiens
gcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgagtccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaa

SEQ ID NO: 6 - DNA, 4092 bp, Homo sapiens
gtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggatgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 7 - DNA, 1578 bp, Homo sapiens; identical to SEQ ID NO: 5

SEQ ID NO: 8 - DNA, 4493 bp, Homo sapiens
gcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagtgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaagtttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaacgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataactttgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 9 - DNA, 1370 bp, Homo sapiens
gaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaataaaaaaaaaaaaaaaaaaaa

SEQ ID NO: 10 - DNA, 1904 bp, Homo sapiens
agctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 11 - DNA, 4571 bp, Homo sapiens
gggggtcgggggtcgggggctgggggctgaggactgagtcgagccagcagcccagggcatctgtccacgctgtcagaggagcctctgggcgtggggctggcccttagagggctactgcgctgcttaacttgcctttcacagaaaaccactggaggagatactcacaaaaatgaaggggaagaacaggaaacaggaagacatgagatgaaggaaacaggagattcaacatggatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagaaaaaaaaaaaaaaaaaaaaaaaaaaaa

SEQ ID NO: 12 - DNA, 4493 bp, Homo sapiens; identical to SEQ ID NO: 8

SEQ ID NO: 13 - DNA, 2483 bp, Homo sapiens
ccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaaaaaaaaaaaaaaaa

SEQ ID NO: 14 - DNA, 6641 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaaaaaaaaaaaaa

SEQ ID NO: 15 - DNA, 3882 bp, Homo sapiens
ggaaaccgggcccgcgcggcggccgccgtcccggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggccagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcaaaaaaaaaaaaaaaaaa

SEQ ID NO: 16 - DNA, 7522 bp, Homo sapiens
cccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaaaaaaaaaaaa

SEQ ID NO: 17 - DNA, 6641 bp, Homo sapiens; identical to SEQ ID NO: 14

SEQ ID NO: 18 - DNA, 2963 bp, Homo sapiens
gttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacgtggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcag

SEQ ID NO: 19 - DNA, 3320 bp, Homo sapiens
gtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctgcggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctccactcacacatgtagacaaacattagctctttactctttctcaaccccttatatgattttaataattctcacttcactaattttgtaagcctgagatcaataagaaatgttcaggagagaggaaagaaaaaatatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaaatgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcaaaaa

SEQ ID NO: 20 - DNA, 3981 bp, Homo sapiens
cgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcaaaaaaaaaaaa

SEQ ID NO: 21 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 22 - DNA, 3969 bp, Homo sapiens
actgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacataacattgaaaaatgaggcataaaaatgcaataaactgttacagtcaagaccattaatggtcttctccaaaatattttgagatataaaagtagggaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaatttttacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttaaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacagttgtatgtctactcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaaaaaaaaaaaaga

SEQ ID NO: 23 - DNA, 3320 bp, Homo sapiens; identical to SEQ ID NO: 19

SEQ ID NO: 24 - DNA, 1595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 25 - DNA, 1286 bp, Homo sapiens
gctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacg

SEQ ID NO: 26 - DNA, 1113 bp, Homo sapiens
ggggcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaggtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaaaaaaaaaaaaa

SEQ ID NO: 27 - DNA, 1416 bp, Homo sapiens
acgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgagaaaaaaaaaaaaaaaaaa

SEQ ID NO: 28 - DNA, 2704 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 29 - DNA, 4731 bp, Homo sapiens
agcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaaggaaaaaaaaaaaaaaaaaaaaaaaaaaaa

SEQ ID NO: 30 - DNA, 3412 bp, Homo sapiens
agttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaatctccaaatacctttttttccccccaaatactttctaaactttttttttttgagatggtatctcactctgtagcccagtctggagtgcagtggtgtgatcatggttcactgcagtcttgacctcccaggcttaggtgatccttctgtctcagccttccgagtagctgggaccacaggcatgcacaaccacgcctggctaatttttgtattttttataaagacagggtttttccatgttgcccaggctggtttcgaactcggctcaagtgatctacctgcctctgcctcccaaagtgctaggattacaggcgtgagccaccatgcccagcctactctaaattattgataacctcttcctccagttgtctcctttaagctttcctgggtctaacctacataggtaatttaagaacatcctcagaaaggacagctgaaggcaataggaggcagattatctctttagggcgtcctcaagtttttttggtctgttctcccacttgattgacctcaccagttgagacacctagtgtatggctcatgcccagccttccacctgggattctccagcctccacccagcagccctggattgctttctccaattaaggcctttccatcagctctctgctttttcaaagcgaaaaaactaatggattagtgggttatcttttccaaggaacaggtttgcacttcttggaaaaagtgcctaaagtgtgcccattaatatgaggatagatttaggctcataagccttttggtaacactgaaagtagtatcatataggcaagctctccttataagtaaggctttcaatttttaaaacagacatcctgctttaacaatttgtaagatgactgtgcagtaataaaagtcctttgtatttc

SEQ ID NO: 31 - DNA, 3320 bp, Homo sapiens; identical to SEQ ID NO: 19

SEQ ID NO: 32 - DNA, 3580 bp, Homo sapiens
agttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgagacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgcttttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttccaaaaaaaaaaaaaaaa

SEQ ID NO: 33 - DNA, 4200 bp, Homo sapiens
gactctcgcctgacttcctaatttgctacttatccccagcgttggtcccggcgaggatatgctgagatttatggcactgttggctgcatttttggagaacagcaagcagcttcttttcagataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 34 - DNA, 2189 bp, Homo sapiens
aggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctaaaaaaaaaaaaaaaaaaaa

SEQ ID NO: 35 - DNA, 3320 bp, Homo sapiens; identical to SEQ ID NO: 19

SEQ ID NO: 36 - DNA, 6894 bp, Homo sapiens
tgacccggtccgtgtgggccagcgggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaagctacatcacccgagaagaccagtacagcaagcctccgcacaaaaaactgaaagaccgccagatcgatcgccagaaccgactcaacagacctccttctgctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtatacattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctga

SEQ ID NO: 37 - DNA, 3963 bp, Homo sapiens
attaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccgaaaaaaaaaaaaaaaaaa

SEQ ID NO: 38 - DNA, 1554 bp, Homo sapiens
aattatatatttttactctatgtttctctacatgtttttttctttccgttgctggcggaagaggcacgtgcgctgctgaatggagctggtcgctggttgctacgagcaggtcctctttgggttcgctgtacacccggagcccaaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaatttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctcaaaaaaaaaaaaaaaaa

SEQ ID NO: 39 - DNA, 2758 bp, Homo sapiens
ctatccgcgcgcgtcgccggcccagtcctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtggcgaaatacaccgagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagatgtccccatcggtcaccttgtttctcaactacctcgcatcattgcagatcgtagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtgcgtgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaagggcaatatgaagttactttcttaatgtgacctagcaataggcatagctacgtggcactatattctggccagactcgatgtgtactctaacttaagaaataaatcagtaaggcag

SEQ ID NO: 40 - DNA, 5748 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 41 - DNA, 2921 bp, Homo sapiens
agcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaaaaaaa

SEQ ID NO: 42 - DNA, 7561 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaatgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaacacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttatttttttttttaatttatagagcatttcggggggggtgggg

SEQ ID NO: 43 - DNA, 1561 bp, Homo sapiens
cggccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgaaaaaaaaataaaaagagaattttgtaagaa

SEQ ID NO: 44 - DNA, 2487 bp, Homo sapiens
cctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaaaaaaaaaaaaaaaaa

SEQ ID NO: 45 - DNA, 1561 bp, Homo sapiens; identical to SEQ ID NO: 43

SEQ ID NO: 46 - DNA, 2881 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 47 - DNA, 1885 bp, Homo sapiens
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtg

SEQ ID NO: 48 - DNA, 3089 bp, Homo sapiens
aaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataat

SEQ ID NO: 49 - DNA, 3007 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaatt

SEQ ID NO: 50 - DNA, 3452 bp, Homo sapiens
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttgtgaatcctttggccacattttgccctgcttctctcagggttaagggttctggaagaacattaagaatgagatgcaattgaaaatagtcattttgaatcctattgattattcaaaaattcaggctgattgtcttttatcagaggtaggattctgttttatagtatagaatctactttatcccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaaaa

SEQ ID NO: 51 - DNA, 6641 bp, Homo sapiens; identical to SEQ ID NO: 14

SEQ ID NO: 52 - DNA, 3778 bp, Homo sapiens
gacgacgtttgggagcctttgctgagtccagggagagaggcgtcccccaccgtgccgctgcagctcgggcagagccgccaagctttggggtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgcactcttcatggaaagcaactcttgcccctcctcctctgggcacagggtgtgcgttcagatgacttggctcctactcaagggctttcttcccctttaactctctccttctggtgacacatcctgcagcagctgagggggtgccctggcactggctgggagtggagaggcactgtggtgaaatggctccagaggtctgtacatcacatacatatgcacacaggcacacatggcaaaactcggaagtgaaaggacttgtctgaaatcacatggtgagaaggaggatgaagggaggagagagcttttgctctgggtctccagtggataggagaggacctgcctcctgggtgagaagggtcagattttcctattttaattgctttagggaagagcaagcagagtcatgaccagggacacagctgagagatagaggaggctgtgaatgctgagaccagagtttatcatgctggacaagcctggaaggaggcaataagtgggaaaggtaggaggagagaaggctggggagggctgggcagcaagccaggcacagtgagtggcagagcaagagggggaaagcaggatcagtgcctggaaggcaggtgtgcccgtcagcggggagtggaactcatcaggcttgccaagaggttggaagggaaatggctctgggctggaactgtcttcccttggtccttctggtccaggccttggaggaaagcagaggatgatccctgcctgtgagccacacctcctagctctgggggcaaaggggcttagtaaaggaatgctggatgtgtagagggtttagtcccgagctcaggaaatgagagcctataagtgcccagtacatgtttaaaagaagagctcatggaacctctggaaaggacagggaagttgagttagccacataaatgaacccaagtcacattggaacacagagctggtctgggaactgtgttggctgccaacagaacttctgaccctgttacctgtgaaatgaggcagtttccctcacgttgccatcagctaccaggagcgatgctggtggtcactagcttctgatcctcatcctgggtgtggccacagattgggggaacctggattgtggagtcacatcctccctgcaaagcaagcagggcaagggagatctggcattttctgctttacgtggagggagaacaggcacattagccttgaagctgaagctcattttaggttccttccaggtttagaagcttcaaccaaatgaaacttgaatctgtccctcgtgacaattataggaggaaggtatttaaaaccccagatttatgaatgtgtactacatggcttagagaatgtctttgttcttgttcaggtggttataacaaaataccttaagagtggattacaggcatgagccactgtacctggcgaaaaacagtttgttaacacaggcagccaacatcactcaggataagcctcaatgaaaagtaacaaagtgatggcttggaacactgtcttacacagcatttttaaaaaatacaataaatttgtagagataggatgaccaaggacaacagttttaggcttccaaaggtggtaaactatgggatggtaaatatccgagaggaagctgatgcaacaggatttgtctgcagcagcctctggtaccacctctgagtcaagggttgtgtccagtgatggagagtttatatcgtgcctttaggcagaaaaggggagggaaacctgaacttttcctgcactttctgcttcttaattgccttcagctgaaaatcattttttatgtgaaaaaggcatagtctgagctgacgcctctgctttcctccacctgaagagaacctgcgtgctgctcctttgcttcggacctccgcctctgcccgggagaaagcccaggccagcctgctggacaagcagagaccatgagaaggagagttcaggggtcccaatccaggccatcctagaccagccagctccagctgatccgcacgcagccacttcggctaccttctactggccaaagggagtcccagggctcacccagattcagaggtggggaaactgagtccaccacttgagaagagtagctataaagacatatgagcgaggccagctgagcccagcactgcggccaagtcgaagactttaggagcaataaaagtgcttattgtgtttcagaaaaaaaaaaaaaaaaaaaaaaaaaaaa

SEQ ID NO: 53 - DNA, 3110 bp, Homo sapiens
ttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgaaaaaaaaaaaaaaaaaaaaaaaaaaaaaaaaaaaaaaaaaaaaaaaaaaaaaaaaaaaaaaaa

SEQ ID NO: 54 - DNA, 1796 bp, Homo sapiens
ggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaaaaaaaaaaaaaaaaaaaa

SEQ ID NO: 55 - DNA, 5748 bp, Homo sapiens; identical to SEQ ID NO: 40

SEQ ID NO: 56 - DNA, 1378 bp, Homo sapiens
cgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatgaaaaaaaaaaaaaaaaaaaaaaaaaaa

SEQ ID NO: 57 - DNA, 1578 bp, Homo sapiens; identical to SEQ ID NO: 5

SEQ ID NO: 58 - DNA, 2709 bp, Homo sapiens
gggaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtgcatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccagcttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaacacaatcaactgtgaggaaggagataaactgaaactcaccagctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtccctaaaaaaatgtacatatacctggttgaaatacaacactatacatacacaccaccatatatactagctgttaatcctatggaatgggggtattgggagtgcttttttaatttttcatagtttttttttaataaaatggcatattttgcatctacaacttctataataagaaaaaataaataaacattatcttttttgtgaaaaaaa

SEQ ID NO: 59 - DNA, 5748 bp, Homo sapiens; identical to SEQ ID NO: 40

SEQ ID NO: 60 - DNA, 2709 bp, Homo sapiens; identical to SEQ ID NO: 58

SEQ ID NO: 61 - DNA, 4399 bp, Homo sapiens
ggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggataggcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaaatgcaagctgtcaggatgcttaagctcttttcagacatctgcagtttcattcctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtccaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaa

SEQ ID NO: 62 - DNA, 737 bp, Homo sapiens
ggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagcgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagct

SEQ ID NO: 63 - DNA, 3583 bp, Homo sapiens
acttgcgtctcgccctccggccaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcaggcctggaacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaagctggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagaccgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcacctgcacaccccctttcagagggccactgggttaggacctgaggacctcacttggccctgcaagccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcggcatccagaagcagctgcagtgttgctgccaccaccctcctgctcgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtacctgcggtgaggaagctgggcgctgttttcgagttcaggtgaattagcctcaatccccgtgttcacttgctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacggggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaaatcatacattgcttttttattctacatgggtaccacaggaacctgggggcctgtgaaactacaaccaaaaggcacacaaaaccgtttccagttggcagcagagatcaggggttacctctgcttctgagcaaatggctcaagctctaccagagcagacagctaccctacttttcagcagcaaaacgtcccgtatgacgcagcacgaagggcctggcaggctgttagcaggagctatgtcccttcctatcgtttccgtccactt

SEQ ID NO: 64 - DNA, 3882 bp, Homo sapiens; identical to SEQ ID NO: 15

SEQ ID NO: 65 - DNA, 2709 bp, Homo sapiens; identical to SEQ ID NO: 58

SEQ ID NO: 66 - DNA, 4793 bp, Homo sapiens
atatttcaggggatatgaatcccctacattaagtaaggattatgagggctacccagccccagcaatgccagattttcaacctggggataccacagtaagactagacaaaagaatgtctcttactgcaatatatgacaagaggagagagacagattatagtgacaaaggatataatttagcttttgtttctcaagatgaacaagaaaattcttcctttactatatacgaagagccccttcaagaggaggacaagtatgcttccgcagaagcaagacaaacacagtctgtcttgtttcatgatacgtccgctgacagcatgcctgttctggcatgtgaaaggtctgagagtagaactgaccttgtccatcactttgaaaaaggtactaaattaggtgagacatttgatagtgatagttcagaaatgttcttatcagtggaggccaaaaggtacaaaatttatcctttagcattgtctcccatttatgaggatgacagctcacaggaggacattctatctagtgaggtttcacctggtcaccatggccccaggaaatcaagagacagtgaaaaccagtcctcttctgttttatcccttctccagtcagtgtcagaacgtttaaagatgaattttgatgaagatgacagagaggcagctgatgaggaagaagaggaggaggaggcagcagtattgcataaaggagatctgagagctggaagtggggagcgtgttaccttccagttgccagatccttccatcacattttaccctgatgaccaggagagcgttggaatttctaagaattcatatgtgataccaaatgaacctactacctccaatctgcaagttggtctgtggccagaaaagacctcgtttctccagaaatctgaccttacttctaaactacattcttctttaaagagtgcttatcatcagtatctgcagacttcccaaagtcattcctcagaaaaaggagccagatttggtggaatttttcaggaaccagtgtcaaaatatttccgtgttcaagacagcccaggcagattgagcccatttatagagaatgttgacaaacaaactctgagatgtaacccaagacctgggaagatggttatctatgatctccatgaaagtacatataaacaagaagtctactgtaatattcctgatgctacatcatggtcttttccaaatggagttctaataaaagttgtaaggggctgctggattttatatgagaaaccacatttccgaggtcagaaatgtgtgctagaagaaggggaaaaggtgttaaatcgtgactggattcttcagaacagaaggcatccacaaagaaactttatattgggttctctcaaacgtgtcttaaaggactgcagcattccagaaatagagcttttcccacaatctgacccagcctgttgtcctgtctacatacagacagcagtccccaatttggaagaactgaatatctccaaatctgtgtccttcactgtgaagtcaggagtttggcttgcctacccagatattaattttaagggacaagctacagttctggaggaagaccatgggctctttgagatttctacagcagaaatgaaatcattacatccgcttcaaatgggtggactgaaagtggaaatgcccatgaacttaaaggttattatttatgaaaaacctcacttccatggacaggctgaagagtttagtgaacatatagattctgttcctaattttttgaaaaataatggagattttcacagaattggatcaattcgtgtcattggtggagtgtgggttgcctatgaaaaagaacattttaaaggccagcagtttctgcttgaagaaggagactttgaagacagtaatgcttgtggtgcattaagtagccctatcttgtctttccggtacttacaagctaattttatagaatcttctgtcacactatttgaatctgacctagaaagtgggaagtttattgacattacaaatcaggaaatttctgatttggaagaaattggctttggcagtaaaacaagatccattcatgttaaaagtggagtatgggttgcctaccagcaaaagttcttctgtggagaacaatacattttagaaaaagggaaatacaaatgcttttttgactggggaggatcaaataatataatcatgtcgatacggccaatccaactggaaccacttgggataaatgaacctccgcatttgctcaaagcattcagcaaaccagggttccaaggtgaatgtatagattttacagaagaaacttctgatttgacttcactcatgccatgtccttttaaagttcttcgaggttgctggctcctctattaccaagaagacatgtttgttaatcactgtgtgttagaagaaggcctctatgctgaccttacttcctgcggttgcccagcatctaaagtcaaatctctcaagcccattgactatgtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagcatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaagggggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtcatacttttgcaaacagatgatgagtaattttttagcaacacctgaaaatatactaaactttcctagataaactttaaggtttctatactgaggcttttataatgaacgcacctcgttaagtatttatacttgtaactaaccccaggcagggacctcagctttgttaggaataaggcacaagaagtattttctgtagctattgtttcctcagtccttcaaactaaaaaagtacaaataaataacctatggccaaacttgcactgttacgtgttaaccaagacatccctttaggtgacaagactctataacagtggttacctgtctccatgttgacacttcatcctagatttaaggagaggcatcaatttttttttttttgcctcaagagaaatttcaaatatccaaattaaaacacagtagcatttgaaccttgaccttaccatctctttaagtaaacgtggagttgatttctctactaaataacagaaacctcagtttttcactcccattgtaagtaacttttatttaagtaagtaaaatcaggtaggaaatcacctttgacttagcttccagtagtcattaccaccttttactgcacaattcacaagcatgttttcctggtgaattggactgaaaattacattttgacaactttttttccttttatccccaacttttgccagaaagcagaaaaatgctctatttttataaagaaagattaaattctccaatgatattttaaaaaatatcaacctacatgcactttagaatgtaaaataacaatgactattttaaactcgaagacccactattttgagtattttttatagactttaaatactgggtttttttcctccttcaatctcaggcttttctccatcttttaagcagcctctgtaactcccttttgtccataggtgttgcgtgcctctcatctgtggggaagtattatttaataaaatttatgttacaggataactttattttaatgggcatgggcttgtctatacacaaaggtatgtatattttcattataaaaaaccagtttaaaattttttcttattttaattgtttgaaatttttctagagccaaagaagctctttaaagaagttgtttcttccaaagaacaaagccaggttaatgacattcaattctaaatgatacattggaattgtgccttttctaccacactggattaaataaacttgtcaaaaaaaaaaaaaaaaaaa

SEQ ID NO: 67 - DNA, 1794 bp, Homo sapiens
tacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattaaaaaaaaaaaaaaaaaa

SEQ ID NO: 68 - DNA, 847 bp, Homo sapiens
ggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagcccccccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaaaaaaaaaaaa

SEQ ID NO: 69 - DNA, 3767 bp, Homo sapiens
gataagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcggctgcaggcctcccactgccccctgcggctgctgccatccccacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaaaaaaaaaaaaa

SEQ ID NO: 70 - DNA, 2210 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcaaaaaaa

SEQ ID NO: 71 - DNA, 3858 bp, Homo sapiens
gccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaaaaaaaaaaaaaaaaaaaaa

SEQ ID NO: 72 - DNA, 2336 bp, Homo sapiens
cttttcttccgcacggttggaggaggtcggctggttatcgggagttggagggctgaggtcgggagggtggtgtgtacagagctctaggactcacgcaccaggccagtcgcggattttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaagctgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccatgattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcaaaaaaaaaaaaaaaaaaaaaaaaaaaaaaaaaaaaaaaaaaa

SEQ ID NO: 73 - DNA, 2956 bp, Homo sapiens
ctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttaaaaaaaaaaaaaaaaaa

SEQ ID NO: 74 - DNA, 3332 bp, Homo sapiens
ctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcgccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaa

SEQ ID NO: 75 - DNA, 2059 bp, Homo sapiens
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacatatccagtactcctggttcctaggtgagcaggtgatgccccagggacctttgtagccacttcactttttttcttttctctgccttggtatagcatatgtgttttgtaagtttatgcatacagtaattttaagtaatttcagaagaaattctcgaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 76 - DNA, 2416 bp, Homo sapiens
ggagtgattgcccggcagagcgcgatactcgtttgtagtttcataaacattgatgttgggtcaatcatgttctcaatgtatttaaccatgtgtttttaaattttttaatttagttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcaaattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaatgcagtggcagaaacttttgtttgccaaacagaaaaattttcacctcgtcagatttctgcgttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagtaaaaaaaaaaaaaaa

SEQ ID NO: 77 - DNA, 2691 bp, Homo sapiens
gcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctcctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 78 - DNA, 7522 bp, Homo sapiens; identical to SEQ ID NO: 16

SEQ ID NO: 79 - DNA, 4731 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaa

SEQ ID NO: 80 - DNA, 2483 bp, Homo sapiens; identical to SEQ ID NO: 13

SEQ ID NO: 81 - DNA, 4602 bp, Homo sapiens
cccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcacaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccataagttaaaatctgaaggttatctttatcatgtttcatccctgtctgaagatttcctagtcttcttatgtaaatcacatgactcatgtccgtaaatgaactatgaaagatatcgatcagtttatgatcattgacatgtgatttcaaaacacagtgttcttttaaaaatctataatatgtcaaaatacaagttttttttttttacatcgttttagtaagttaatttcatttatttactttggagctatatttccacttagaaaaactaaggtaattttacaatatatgctgagattaaaaaccaaggtaaaaatgatcaaacatatatgaaattgagtcttagatttaatgaatttcactcgaaaataaatgatcagaagaatt

SEQ ID NO: 82 - DNA, 1854 bp, Homo sapiens
gcccgctgcggtcacgctgcgcccggcgccgcagggtgggcggcgaggcactcacgagggggacgctgagggcttccgcgcgggccacccgggtcaagcgcgctccgccgggaaacttctgcgggcgccgggctgaagctccgggcagggctgggaaggaaaggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgtatttctcattgttataattggggagggggtggataactatgggcagtttgcccttttctgcatcaaaactgggagaatgaaattccactttctcaattcttttctcacatttactcaaatgcattgtcttgccctatggactcaggagttgcttctcaagaaacagccagcaagtattctcagcctgagggtgggttgctactgtccacataggcatttccggaattcacttttttgctacaacctccagtgaaagcaattattttaaatgtgcagttacttgatgtgactaaaaagtagaataaatgcaagagataataatatgtgaatcttgaagcctattttattgctacaaataaaataacatttaaaaag

SEQ ID NO: 83 - DNA, 1790 bp, Homo sapiens
agcgcgcggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcaccggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgctagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaac

SEQ ID NO: 84 - DNA, 778 bp, Homo sapiens
caggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaaaaaaaaaaaaaaaa

SEQ ID NO: 85 - DNA, 3338 bp, Homo sapiens
gacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttgggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcaaaaaaaaaaaaaaaaaaaaaaaaaaaaaaaaaaaaaaaaaaaaaaaaaaaaa

SEQ ID NO: 86 - DNA, 5616 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 87 - DNA, 3693 bp, Homo sapiens
ctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaaaaaaaaaaaaaaaaaa

SEQ ID NO: 88 - DNA, 4799 bp, Homo sapiens
gaattccgttgctgtcggcgcgcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagcttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgctttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagtttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctacgccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgcttgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtttcaaaa

SEQ ID NO: 89 - DNA, 1325 bp, Homo sapiens
gcgattcggtggcacgtggagccacggcgtgggagtagggggctgaaggcaggcagcagcggccagggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcaggtgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgaaaa

SEQ ID NO: 90 - DNA, 1851 bp, Homo sapiens
gggcgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctaggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacattcctgattaagacggttgaaactagagatggacaggttatcaacgaaacttctcagcatcacgatgaccttgaataaaaattgcacacactcagtggcaggcgatatattacccaggcaagaataaaaaagaaatcccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaactcca

SEQ ID NO: 91 - DNA, 2395 bp, Homo sapiens
tcggagaccacattgcctcgtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttggtgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaagtatttggctaccagccagatcccctgaactaccaaatagctgtgggctttctggaactgctggctgggttgctgctggtcatgggcccaccgatgctgcaagagatcagtaact

SEQ ID NO: 92 - DNA, 1658 bp, Homo sapiens
aagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaaaaaaaag

SEQ ID NO: 93 - DNA, 5748 bp, Homo sapiens; identical to SEQ ID NO: 40

SEQ ID NO: 94 - DNA, 3224 bp, Homo sapiens
agcggtaaatttgaaatggctgacgggtcgctgacgggcggcggtctggaggcagcggccatggcgccggagcgcacgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaagtgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtggtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaagaaaaaaaaaaaaaaaa

SEQ ID NO: 95 - DNA, 4168 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgcaaaaaaaaaa

SEQ ID NO: 96 - DNA, 1378 bp, Homo sapiens; identical to SEQ ID NO: 56

SEQ ID NO: 97 - DNA, 4925 bp, Homo sapiens
gaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaggctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaacacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcaaaaaaaaaaaaaaaaaaaaaaaaa

SEQ ID NO: 98 - DNA, 4731 bp, Homo sapiens; identical to SEQ ID NO: 79

SEQ ID NO: 99 - DNA, 3969 bp, Homo sapiens; identical to SEQ ID NO: 22

SEQ ID NO: 100 - DNA, 1501 bp, Homo sapiens
ggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcaacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 101 - DNA, 3067 bp, Homo sapiens
ggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaactacaa

SEQ ID NO: 102 - DNA, 508 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaa

SEQ ID NO: 103 - DNA, 1412 bp, Homo sapiens
gcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacaaaaaaaaaaaaaaaaaaaaaaaaaaaaaa

SEQ ID NO: 104 - DNA, 686 bp, Homo sapiens
gagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtttaaaaaaaaaaaaaaaaaa

SEQ ID NO: 105 - DNA, 5507 bp, Homo sapiens
ggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtggtctcagctgcttgggaggctgaggcaggagaatcgcttgaacctgggaggcggaggttacagtgggccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttgtttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttgctgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 106 - DNA, 2329 bp, Homo sapiens
aggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagttgcataaagtgccctcacactgctgtgcagccattaccaccattcatctccagaatttgttctcagtcccaaactgaaactataccattcaaacaacagcgctccccatttc

SEQ ID NO: 107 - DNA, 4763 bp, Homo sapiens
ggctcactgcaaccccgcctcctgggttcaagcaattctcctgcctcagcctcccaaggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcccggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatgaaaaaaaaaaaaaaaaaa

SEQ ID NO: 108 - DNA, 2727 bp, Homo sapiens
ttcttttcacacttggtctctgcccagccgtcttgtccacgcagcttcgtctgtattaactcctccagccgcagcccactcactccccgccgtcggtgcatggccggcgtccacgctgtgctccctcctcggcggccacgcgcgctcggcggctccttccagcaggggcttgcgcttctgtcgggtctgtgccgctgggagacccgctgcagttttcacactgtgcacactctggaaatgtgttgacaggaactgcttttcatgtcttccctgagaggggtacccattttcaaacaccaggttcctttccaggaagggaggcaggagcacccgtctccgctccactcggatccttcgaccctgccgagcccggctccgcgggcaccttgcttgcatgcctcttcctccttcccgtcttcctgtcactcgttctgctgagcacgtgtcccagccacagaggcccctgtgcgtcccctccctgcccagcaccgtcactgtggtatctgcctggccggctcccccagccccatgctgaccttctcctgtgctttggctccgacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagagcgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacatcgtgtcagctgtgcactgacggccagtctccgagctgtgcgtttgtatcgccactgtatttgtgtactttaacaatcgtgtaaataataaattcataatgacttctaccttt

SEQ ID NO: 109 - DNA, 2583 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccagggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggccatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacaaaaaaaaaaaaaaaaaaaaaaaaa

SEQ ID NO: 110 - DNA, 1883 bp, Homo sapiens
agttccgcgcggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtgaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgaatgtgtaactaacttctcaaaatgaatctatttcataactcggacaatttctgggtggtgactgagtacccctttagtgagtacccctttagtgctatatttgtgccattcattatctggttcatatttctttgctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgcaaaaaaaaaaaaaaaaaaaaaaaaaaaaaa

SEQ ID NO: 111 - DNA, 4352 bp, Homo sapiens
gatctgcgcatgcgcactcgaggcaaggcggccactcccagaagtctccggggctcgagcggtgggtgggaggcgcggtccaagtggtcgctgccgtatttctcgtaggtttttaggattctggactccatttctcaccggtacctgcggtcctgactgttctggcttggactacatattccaaaggcaacggagaaaacttggacccctggctccggttccgggaccttttggttccacatgaagaaggcggcgcaggtcactgcgggagcctctgcagccccagcccgccgcccgcgtggtaccctgcgtggcggtgagagtggggctgcaggaggcgctcagagcgcggaggcccccaggcgggccgggcgagtctcccgcctccccaggccctagggtgctggagctgcggaggaggggcccgtctctaggagacaggcggggagcgtgagagaccgcgcagcggcgacaggaccggcttgcctgtgtgacgtgggtgcagttgcgggactgtgaggggtcttggttcttttgactttgctcttctggtagagaaacgccaaggactgatcaactcttgccagtctcaaaccatggcctatggatcaataacattcggggatgtggccatagacttctctcatcaggagtgggaatatctcagcctggttcagaagaccttgtaccaggaggtgatgatggagaactatgacaacttagtctcattggcaggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacgggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagagaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcatagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaagctacatgaaatatactgttacgttcaataaacattagcttctgtat

SEQ ID NO: 112 - DNA, 2499 bp, Homo sapiens
gtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatattagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 113 - DNA, 4763 bp, Homo sapiens; identical to SEQ ID NO: 107

SEQ ID NO: 114 - DNA, 3668 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtatttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtataaaaaaaaaaaaaaaaaa

SEQ ID NO: 115 - DNA, 2000 bp, Homo sapiens
cttggcacgagggattggtctgtgctcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttatcctgaaccttggcagacacgtcttgttttcatttgattttgttaagagtgcagtattgcagagtctagaggaatttttgtttccttgattaacatgattttcctggttgttaatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaccaaaaaaaaaaaaaaaa

SEQ ID NO: 116 - DNA, 2139 bp, Homo sapiens
gctgcaggaagcagcaggagacgcccggcagccgggacggtcggggacgcctgaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtgctagaagcggtttccaggccaccgttctcctgcctacatcccattcatggctgcttgcggtgtcactgggctaccgtgagatccaagttgaaattcagaagcctactttgatggtaggtttgaatgacgtgtcctacagcctcagaggcagcaggaggctagcaaagctttaaatgccttccttctctgcccccagccttctgtcccccttggaggagggctgtaggaagattccctcttcctgccaagccaccttccagtgagctctggatgaagctctggccaaccaaagacactgtccccacagcaggtgcctggtgggccagtgttctcacactggtggaggagctgggcttctctccaaggacaaacttactatggaagcagccatatttgagt

SEQ ID NO: 117 - DNA, 1322 bp, Homo sapiens
tagcttggcacgaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgccttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggacccggcgggtgtgcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgagccgattaaaagaccgtgtgaaatg

SEQ ID NO: 118 - DNA, 2833 bp, Homo sapiens
tgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttccttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcaac

SEQ ID NO: 119 - DNA, 8482 bp, Homo sapiens
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccacgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 120 - DNA, 6450 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgcctttgggggtgccctgggatccctggggtagtccagctcttattcatttcccagcgtggccctggttggaagaagcagctgtcaagttgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccaaggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaataaagtcatacagtagctcaaaaggcaaccataattctctttggtgcaagtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcatttttttgcatccaattgtgcctgaacttttaaaatatgtaaatgctgccatgttccaaacccatcgtcagtgtgtgtgtttagagctgtgcaccctagaaacaacatacttgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 121 - DNA, 4763 bp, Homo sapiens; identical to SEQ ID NO: 107

SEQ ID NO: 122 - DNA, 3018 bp, Homo sapiens
cgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaaaaaaaaaaaaaaaaaaaaaaaaa

SEQ ID NO: 123 - DNA, 1186 bp, Homo sapiens
gatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagc

SEQ ID NO: 124 - DNA, 1830 bp, Homo sapiens
ggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttaagcttatagtaaggatacattcaagcttggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaaaaa

SEQ ID NO: 125 - DNA, 3124 bp, Homo sapiens
taagatccacatcagctcaactgcacttgcctcgcagaggcagcccgctcacttcccgcggaggcgctccccggcgccgcgctccgcggcagccgcctgcccccggcgctgcccccgcccgccgcgccgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaaaaaaaaaaaa

SEQ ID NO: 126 - DNA, 4184 bp, Homo sapiens
ggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagaacctacattaagaaacgcattcagatgcatcagccgtttgtaaagcacctgtcgtgagccagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgctggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtcagcaagtcctgggcttggtggagaaccagagtgactggtaccttggaaacctgtggaaaaatcaccgcccatggccagcccttggaagaggctacaacacaggggtgatcctgttacttctggataagctgcggaagatgaaatgggagcagatgtggaggctgaccgcagagagggagctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtt

SEQ ID NO: 127 - DNA, 2610 bp, Homo sapiens
atcctgggacagggcacagggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggaacgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcagcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctacagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattct

SEQ ID NO: 128 - DNA, 3844 bp, Homo sapiens
aaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatataccacaaaaaaaaaaaaaa

SEQ ID NO: 129 - DNA, 2787 bp, Homo sapiens
gcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgct

SEQ ID NO: 130 - DNA, 2347 bp, Homo sapiens
ggacgcgtgggcggacgcgtgggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctataagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatgaaaaaaaaaaaaaaaaaaaaaaaaaaaa

SEQ ID NO: 131 - DNA, 3053 bp, Homo sapiens
gcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctatgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaggtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttgtggggagcaagggtagccaatggcagagggggttggggctgggactctggaggctcctccccttctttctcttccttctgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaaaaaaaaaaaaaaaaaaaaaaaaaaaaaaaaaaaaaaaaaaaaaaaaaaaaaaaaaaaaaaaa

SEQ ID NO: 132 - DNA, 3197 bp, Homo sapiens
gcggggcggcggcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 133 - DNA, 1386 bp, Homo sapiens
ggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcagaaaaaaaaaaaaaaaaaaaa

SEQ ID NO: 134 - DNA, 2064 bp, Homo sapiens
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaaggccgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaa

SEQ ID NO: 135 - DNA, 3413 bp, Homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccg

SEQ ID NO: 136 - DNA, 3000 bp, Homo sapiens
cccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctataatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccctagtatatggcatatgaataccaggatagctttataaagcagttagttagttactcactctagtgataaatcgggaaatttacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaacaaaaaaaaaaaaaaaaaaa

SEQ ID NO: 137 - DNA, 3823 bp, Homo sapiens
cgcctaggctggagcgccgtggtacagtcttgactcactgcaattctgcctcctgggttcaagtgattcttgtgcctcagccattgagtagctgggatgacaggcacatgcctagctaatttttgtattttttgtagagacggggtttcaccatgttgaccaggctggtcttgaactcctgaactcaattgatccgcctgccttggcctcccaaagtgctgggattacgggcatgagccactgcacccagcaatgagtagtcttaatgaggaaagtaggtcatagtaatctgcagaatactgtagataaagaaactgagaaaaacctatttggttcccatttagtaaatatctatattccttataatatgtctatttctcctaagaaactttccactttagacacttgtaagaaaaattaaaattggttgttattgcagttgtttgtcttatttcactttttttccccgggtttcccttcagtaatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccaggctgatgtcatttagatatccgttctggccagtgggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactggaaaaaaaaaaaaaaaa

SEQ ID NO: 138 - DNA, 3591 bp, Homo sapiens
cgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtaaaaaaaaaaaaaaaaaaaaa

SEQ ID NO: 139 - DNA, 6468 bp, Homo sapiens
gagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcagacggagtttcgctcttgttgcccaggctgggagggcaatggcaccgtcttggctcactgcaacctccgcctcccgggttccagcgattctcctgcctcagccttccgagtagctgggattacaggctcctgccaccacgcctggctaggaaattttttgttgttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgc

SEQ ID NO: 140 - DNA, 4540 bp, Homo sapiens
cgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccgtgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtcgttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacaaaaaaaaaaaaaaa

SEQ ID NO: 141 - DNA, 2357 bp, Homo sapiens
gaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggtggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacgggggggtggtgtgtgccgtgaccatcagcaaccccagcaggcacgtctacacaggtggcaagggctgcgtgaagatctgggacatcagccagccaggcagcaagagccccatctcccagctggactgcctgaacagggacaattacatgcgctcctgcaagctgcaccctgatgggcgcacgctcatcgtgggcggcgagggcagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctcacaagtaccagctgcacctgcacgagagctgcgtgctctccctcaagttcgcctactgcggcaagtggttcgtgagcactgggaaagataaccttctcaacgcctggaggacgccttatggagccagcatatcccagtctaaagaatcctcgtctgtcttgagttgtgacatttcagcggatgacaaatacattgtaacaggctctggtgacaagaaggccacagtttatgaggtcatctactaaacaagaactccagcagg

SEQ ID NO: 142 - DNA, 1322 bp, Homo sapiens; identical to SEQ ID NO: 117

SEQ ID NO: 143 - DNA, 6491 bp, Homo sapiens
ccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgtttcctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaactaacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctcccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacaaaaaaaaaaaaaaaaaaaaaaaa

SEQ ID NO: 144 - DNA, 4932 bp, Homo sapiens
tgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgatgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagcttcttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 145 - DNA, 3992 bp, Homo sapiens
ataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaaaaaaaaaaaaaaaaaa

SEQ ID NO: 146 - DNA, 2222 bp, Homo sapiens
ggctcgagtgcctggcgggctccggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagagaccctggacgtttttctgctctcttctggccctccatggagtcatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaatttggcttttgttttggaaaaaaaaaaaaaaaaaa

SEQ ID NO: 147 - DNA, 1499 bp, Homo sapiens
tatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctcaaaaaaaaaa

SEQ ID NO: 148 - DNA, 1960 bp, Homo sapiens
atgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacaatggaaatcaataaatctgaattccgaacatgttgtgtggaatactcttaagtgtgtttgagagtagatctgccaattatgttgacaagggaatgatcaaaagctttgttttttta

SEQ ID NO: 149 - DNA, 3398 bp, Homo sapiens
cccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggacttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcagctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttgttttactcacctaacccttagaaaatgaatgttagaaggtgcctgccgaggcgggacagagtgtttgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcaggctagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatcaaaaaaaaaaaaaaaaaaaaaaaaaaaaaaaaaaaaaaaaaaaaaaaaaaa

SEQ ID NO: 150 - DNA, 5886 bp, Homo sapiens
gtgaggagggccggcggcggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgtctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggcctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatcttcataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagcgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 151 - DNA, 2687 bp, Homo sapiens
ctggcagcccccttcattgcacctatctcccccatctcattgccacggctgaaccctccttctcaatcttggaacagcacccccttctttaagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactgaaaatacaagaaattagctgggactacaggcatgcgccactgcgcccagctgatttttgtatttttagtagagacggtttcgccactttggtcaggctggtcttgaattcctgacctcaggtgatccgcctgccttggcctcccgaagtgctggaattacaggcgtgagccactgcgcccagctacctgtcatttctaatatagcctgcagggggaaccaaaaaaaaaaaaaaaaaaaaaaaaaaaaaaaaaaaaaaaaaaaaaaaaaa

SEQ ID NO: 152 - DNA, 2384 bp, Homo sapiens
atctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttaaaaaaaaaaaaaaaaaa

SEQ ID NO: 153 - DNA, 6259 bp, Homo sapiens
gggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgc

SEQ ID NO: 154 - DNA, 6779 bp, Homo sapiens
tacggctgcgagaagacgacagaagggggagacggcgggagaggagcgcggcgagcggaggcggcgccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagagctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctggaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatccagcggcgggaccatcacatccagagggccatcggtctctccccaatgtccttccccaccgccgaccttactctgaagatggagtctgcgcgcaaggcttgggaaaacccccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaagcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgtgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcggacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaaaaaaaaaaaaaaaa

SEQ ID NO: 155 - DNA, 2329 bp, Homo sapiens; identical to SEQ ID NO: 106

SEQ ID NO: 156 - DNA, 685 bp, Homo sapiens
gccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgaaaaaaaaaaaaaaaaaa

SEQ ID NO: 157 - DNA, 3067 bp, Homo sapiens; identical to SEQ ID NO: 101

SEQ ID NO: 158 - DNA, 2385 bp, Homo sapiens
atggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagg

SEQ ID NO: 159 - DNA, 2047 bp, Homo sapiens
tttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaatggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttacctgtgtgaaattaaagtttaagagacctaaaaaaatgtactcccataaagaatcaatactgcttcaaaaaaaaaaaaaaaaa

SEQ ID NO: 160 - DNA, 3239 bp, Homo sapiens
gcttggggaacgaggagcaggacgcggcctcggtggggcccgggccgaacggctgcggacacctgggcgccgaggagccgagcgccgccgtctccggcatggatcagtgcgtgacggtggagcgcgagctggagaaggtgctgcacaagttctcaggctacgggcagctgtgcgagcgcggcctggaggagctcatcgactacaccggcggcctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagtgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctatgagtgactacaaaaaggattagactgagccgaataaaaaaaaaaaaaaaaaaaaaaaaaaaaaaaaaaaaa

SEQ ID NO: 161 - DNA, 3507 bp, Homo sapiens
ccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgtgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgattgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaataaaaaaaaaaaaaaa

SEQ ID NO: 162 - DNA, 2422 bp, Homo sapiens
gtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggccgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctaaaaaaaaaaaaaaaaaaa

SEQ ID NO: 163 - DNA, 6468 bp, Homo sapiens; identical to SEQ ID NO: 139

SEQ ID NO: 164 - DNA, 2398 bp, Homo sapiens
ccacgcgtccggcagcggcctcgggggttggggggctgtgtgagtctcgcagtggggctgaggcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagcagcttgaaaaaaaaaaaaaaaaaaaaaaaaaaa

SEQ ID NO: 165 - DNA, 2626 bp, Homo sapiens
cgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgttttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaaaaaaa

SEQ ID NO: 166 - DNA, 2393 bp, Homo sapiens
agcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggatta

SEQ ID NO: 167 - DNA, 3595 bp, Homo sapiens
gggccaggcgcagctgaaaggcccgcaacccgggaaacgtcaaaacaaacagaaggacttgggattccggagcggtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggactacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtatgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaactcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctgaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggttcccagagggtacatactcctttctggggagagaatgctccctaccatatagttgacggtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattgcaaaaaaaaaaaaaaaaaaaaaaaaaaaaaa

SEQ ID NO: 168 - DNA, 4177 bp, Homo sapiens
tctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtg

SEQ ID NO: 169 - DNA, 3707 bp, Homo sapiens
ctcacgcgtcgaggtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcgtggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattcggtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatatgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaagaataaaaagtagcagtaaaattatatactgaaaacaccaaaaatttagatgccttaatagtatatacgtgaaatactcagctgtccctttaaaaataattcattggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacactggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgtagaaaaaaaaaaaaaaaa

SEQ ID NO: 170 - DNA, 1521 bp, Homo sapiens
ctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctggagagccctgtagccgcgctccatgctccggcagcggcccgaaacccagccccgccgctgacggagcccgccgctccgggcagggcccatgccctgcgcgctccgggggtcgtagctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctga

SEQ ID NO: 171 - DNA, 2744 bp, Homo sapiens
ggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacataaaaaaaaaaaaa

SEQ ID NO: 172 - DNA, 2796 bp, Homo sapiens
cctcccctggggaggctcgcgttcccgctgctcgcgcctgccgcccgccggcctcaggaacgcgccctctcgccgcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggttgtcacagaggcagtggcagcaacaaaggatttgaaaactttggtgtgttcgtggagccacaggcagacgatgtcaaccttgtgtgagtgtgacgggggttggggtggggcgggaggccacgggggaggccgaggcaggggctgggcagaggggaggaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggttaaaaagagaaggcaagcctggcaggagggttggcacttcgatgatgacctccttagaaagactgaccttgatgtcttgagagcgctggcctcttcctccctccctgcagggtagggcgcctgagcctaggcggttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattc

SEQ ID NO: 173 - DNA, 1666 bp, Homo sapiens
agcgggcgcggggctgcgagctagggcgggagaaggagcgcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagagggtgagccgcccatgtctggggcctcctcccattcagtatataccctgagggccctgcaggcaacctgggactcacatgatcgttggatgaccaagttcaggctccaggagccatgcctgagactccctatgtctgcctaagactggtcccagttcggttctctcccacagccagagctggtggaacgtctcattgctgtagatatcagcccagtggaaagcacaggtgtctcccactttgcaacctatgtggcagccatgagggccatcaacatcgcagatgagctgccccgctcccgtgcccgaaaactggcggatgaacagctcagttctgtcatccaggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctggtctaagagttgctggcaagaagatggccgggcgtggtggctcatgcctgtaattccagcactttgggaggctaaggcgggaggatgacttgaggccaggagttggagaccagcctggccaacatggtgaaaccctgtctctactaaaaatacaaaaattagcctggcgtggtggtgcacacctgtaatcccagctactctggaggctgaggcaggagaatcacttgaaccctggaggcagaggttgcaatgagccgagatcacaccactacactccagcctaggcaacagagcaagactctgtctcaaaaaaaacaaaacaaaaaggaggcacaaaaccccaggcttcaagtctctgcagcctgctccacatttgggcacagaaggactcagacaggcactgtgtgggcacgaggttttacaggggtggtcagacctcaggctttaatgaataaagacactactccccaaaaaaaaaaaaaaaaaaaaaaaaaaaa

SEQ ID NO: 174 - DNA, 3812 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 175 - DNA, 1499 bp, Homo sapiens; identical to SEQ ID NO: 147

SEQ ID NO: 176 - DNA, 2007 bp, Homo sapiens
ggcacgaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatctgggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcggtggctcatgcctgtaatcccagcactttgggaggctgaggcaggcggatcacctgaggtcgggagtttgagaccagcctgaccaacatggagaaaccccgtctctactaaaaatacagaattagctgagtgtggtggcgcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaacaaaaacaacgacaaaaaaacccctgcacatgtactccctgaatctaaaataaaagttgaaaaaaaatatatagaatgtgcctggcacatggcaagtactacataagagttatctgttactgttacctattggtttgtttctgcctatgtctgtttctctccctctaactgtgatggttagagagagagattggattggaatccatcttttttccctgtatctttctctccctgtgggtatccctgattttggctccatctggtcagacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacaaaaaaaaaaaaaaaaaaaaa

SEQ ID NO: 177 - DNA, 1610 bp, Homo sapiens
gcctgggctgcggctgtcatggacgcctgggtccgcttcagtgctcagagccaagcccgggagcggctgtgtagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgac

SEQ ID NO: 178 - DNA, 6259 bp, Homo sapiens; identical to SEQ ID NO: 153

SEQ ID NO: 179 - DNA, 1387 bp, Homo sapiens
cgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcatagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagttaataaatttgtcatggttgtctttgattaaaggaaactcaccgccatattcacaaataaaaaaaaaaaaaaaaa

SEQ ID NO: 180 - DNA, 2905 bp, Homo sapiens
cggacgcgtgggcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaactcaaaaaaaaaaaaaaaaag

SEQ ID NO: 181 - DNA, 6307 bp, Homo sapiens
gcgagcggctgttggaggaaggaggtgggggccgggagcgcaaatggcgttgagatggtycarggccctgttcaaactccagcactgaccattcaccggcggaagcggcggcgcaggaggcggcggcggcccagcgggggcacacagcaggctctgttaccagctccagcagtggcggccagcgagagctaggcccgsgcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtarggagcgggagaaggcggargcggccccgtggccaaagcacccgccaggcttccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatac

SEQ ID NO: 182 - DNA, 5387 bp, Homo sapiens
gggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaaaaaaaaaaaaaaaaaaaaaaaaaaaaaaaaaaa

SEQ ID NO: 183 - DNA, 3067 bp, Homo sapiens; identical to SEQ ID NO: 101

SEQ ID NO: 184 - DNA, 4562 bp, Homo sapiens
ggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaatgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggg

SEQ ID NO: 185 - DNA, 4440 bp, Homo sapiens
ccctcccgctccccgcccccgcccccgcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaaaaaaaaaaaaaaa

SEQ ID NO: 186 - DNA, 4989 bp, Homo sapiens
ttttttttttttttgagaaagggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggaggcaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagttctgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggc

SEQ ID NO: 187 - DNA, 1774 bp, Homo sapiens
tgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattatgatcttaggttacataaagtttctaaagtttcaaagagtcttgatacaaaatcagtttatattctgaaaatatttataataaagtattctaatttctaaaaaaaaaaaaaaaaaaaaaa

SEQ ID NO: 188 - DNA, 1507 bp, Homo sapiens
tgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaaaaaaaaaaaa

SEQ ID NO: 189 - DNA, 3463 bp, Homo sapiens
agcggaggagtatgagagcttctcctccgagcaggaggcaagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgaacgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaaaaaaaaaaaaaaaa

SEQ ID NO: 190 - DNA, 3600 bp, Homo sapiens
gaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtaccattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcccttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaaaaaaaaaaaaaaaaaaaaaaaaaaaaaaaaaaaaaaaaaaaaaa

SEQ ID NO: 191 - DNA, 2572 bp, Homo sapiens
gcttccggctttcgctcgcttccatatccgctcctctagtcgccctccgctggccccgccttcgtccccggaagattgggtcctctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactg

SEQ ID NO: 192 - DNA, 794 bp, Homo sapiens
ctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagccagtagccccgaaaaaaaaaaaaaaaaaa

SEQ ID NO: 193 - DNA, 3480 bp, Homo sapiens
cgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccacctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttg

SEQ ID NO: 194 - DNA, 5286 bp, Homo sapiens
gcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggcctgctggtgggtacccttgatgttgtgttggactccagcgcccgggtcgctccttaccgaatcttgtaccagactccagactccctggtctactggaccatcgcctgtggtggttccaggaaagaaatcactgaacactgggaatggcttgagcaaaatctcttgcagacactctccatctttgaaaatgagaatgatatcaccacatttgtgagaggaaaaatacagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattggaaggggaaggtcccccgtcagggttggatgtacctcagcattaaccacctttgcttttattcttttcttatgggaagggaagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacgtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactc

SEQ ID NO: 195 - DNA, 3992 bp, Homo sapiens; identical to SEQ ID NO: 145

SEQ ID NO: 196 - DNA, 4241 bp, Homo sapiens
ggaaagtttgtccggcggcagcggcgttggggactccggcgggggatgcgcgcccggcccctcagcgcccccagcacgccgccgagtcccgctcgccatgggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaaaaaaa

SEQ ID NO: 197 - DNA, 4488 bp, Homo sapiens
gccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaaaaaaaaaaaa

SEQ ID NO: 198 - DNA, 6853 bp, Homo sapiens
gctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagtctctgcagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaaaaaaaaaaaaaaa

SEQ ID NO: 199 - DNA, 3707 bp, Homo sapiens; identical to SEQ ID NO: 169

SEQ ID NO: 200 - DNA, 2194 bp, Homo sapiens
cctcgtgccgagcgacccgggcaagcgacccgggcgcggcgcggggaggctgaagggacgctcgggtaggcaagcgtttgcctcagcatggagggcggggcctcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaaaaaaaaaaaaaaaa

SEQ ID NO: 201 - protein, 231 aa, Homo sapiens
MASAVFEGTSLVNMFVRGCWVNGIRRLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQHLGVDPTEHLFENGSEFPSELEDGDDPAAYVTNLSYYHLVPFETDIWD

SEQ ID NO: 202 - protein, 366 aa, Homo sapiens
MAGPRVEVDGSIMEGGGQILRVSTALSCLLGLPLRVQKIRAGRSTPGLRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 203 - protein, 178 aa, Homo sapiens
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNRCR

SEQ ID NO: 204 - protein, 466 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 205 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 206 - protein, 1264 aa, Homo sapiens
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 207 - protein, 108 aa, Homo sapiens; identical to SEQ ID NO: 205

SEQ ID NO: 208 - protein, 643 aa, Homo sapiens
MEKSSSCESLGSQPAAARPPSVDSLSSASTSHSENSVHTKSASVVSSDSISTSADNFSPDLRVLRESNKLAEMEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 209 - protein, 272 aa, Homo sapiens
MLIGTPTPRDTTPSSWLTSSLLVEAAPLDDTTLPTPVSSGCPGLEPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 210 - protein, 463 aa, Homo sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 211 - protein, 1137 aa, Homo sapiens
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTRTGTRAHSLGIREKISAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEADKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 212 - protein, 643 aa, Homo sapiens; identical to SEQ ID NO: 208

SEQ ID NO: 213 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 214 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 215 - protein, 863 aa, Homo sapiens
MAGPRGALLAWCRRQCEGYRGVEIRDLSSSFRDGLAFCAILHRHRPDLLDFDSLSKDNVFENNRLAFEVAEKELGIPALLDPNDMVSMSVPDCLSIMTYVSQYYNHFCSPGQAGVSPPRKGLAPCSPPSVAPTPVEPEDVAQGEELSSGSLSEQGTGQTPSSTCAACQQHVHLVQRYLADGRLYHRHCFRCRRCSSTLLPGAYENGPEEGTFVCAEHCARLGPGTRSGTRPGPFSQPKQQHQQQLAEDAKDVPGGGPSSSAPAGAEADGPKASPEARPQIPTKPRVPGKLQELASPPAGRPTPAPRKASESTTPAPPTPRPRSSLQQENLVEQAGSSSLVNGRLHELPVPKPRGTPKPSEGTPAPRKDPPWITLVQAEPKKKPAPLPPSSSPGPPSQDSRQVENGGTEEVAQPSPTASLESKPYNPFEEEEEDKEEEAPAAPSLATSPALGHPESTPKSLHPWYGITPTSSPKTKKRPAPRAPSASPLALHASRLSHSEPPSATPSPALSVESLSSESASQTAGAELLEPPAVPKSSSEPAVHAPGTPGNPVSLSTNSSLASSGELVEPRVEQMPQASPGLAPRTRGSSGPQPAKPCSGATPTPLLLVGDRSPVPSPGSSSPQLQVKSSCKENPFNRKPSPAASPATKKATKGSKPVRPPAPGHGFPLIKRKVQADQYIPEEDIHGEMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQRNAIINCLDEDRQREEEEDKMLEAMIKKKEFQREAEPEGKKKGKFKTMKMLKLLGNKRDAKSKSPRDKS

SEQ ID NO: 216 - protein, 1103 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 217 - protein, 1390 aa, Homo sapiens; identical to SEQ ID NO: 214

SEQ ID NO: 218 - protein, 402 aa, Homo sapiens
MIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 219 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 220 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 221 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 222 - protein, 229 aa, Homo sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 223 - protein, 315 aa, Homo sapiens; identical to SEQ ID NO: 219

SEQ ID NO: 224 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 225 - protein, 377 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 226 - protein, 237 aa, Homo sapiens
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGRSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 227 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 228 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 229 - protein, 367 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTGSVLCMTPATSIVPMMHSATSATVSAATTPATSVPFAATATANQIILK

SEQ ID NO: 230 - protein, 651 aa, Homo sapiens
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVSIQKQAPDIGDLGTVNLFKRPLPKSKPGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 231 - protein, 315 aa, Homo sapiens; identical to SEQ ID NO: 219

SEQ ID NO: 232 - protein, 390 aa, Homo sapiens
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 233 - protein, 1332 aa, Homo sapiens
MSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 234 - protein, 566 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 235 - protein, 315 aa, Homo sapiens; identical to SEQ ID NO: 219

SEQ ID NO: 236 - protein, 1204 aa, Homo sapiens
MYVTMMMTDQIPLELPPLLNGEVAMMPHLVNGDAAQQVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSSYITREDQYSKPPHKKLKDRQIDRQNRLNRPPSAIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYTFRLTASNTEGKSCPSEVLVCTTSPDRPGPPTRPLVKGPVTSHGFSVKWDPPKDNGGSEILKYLLEITDGNSEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 237 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 238 - protein, 391 aa, Homo sapiens
MELVAGCYEQVLFGFAVHPEPKACGDHEQWTLVADFTHHAHTASLSAVAVNSRFVVTGSKDETIHIYDMKKKIEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITNEKRISSVKFLSESVLAVAGDEEVIRFFDCDSLVCLCEFKAHENRVKDMFSFEIPEHHVIVSASSDGFIKMWKLKQDKKVPPSLLCEINTNARLTCLGVWLDKVADMKSLPPAAEPSPVSKEQSKIGKKEPGDTVHKEEKRSKPNTKKRGLTGDSKKATKESGLISTKKRKMVEMLEKKRKKKKIKTMQ

SEQ ID NO: 239 - protein, 591 aa, Homo sapiens
MKYILVTGGVISGIGKGIIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVAKYTEFSDSYASVIKALEHSALAINHKLEIKYIDSADLEPITSQEEPVRYHEAWQKLCSAHGVLVPGGFGVRGTEGKIQAIAWARNQKKPFLGVCLGMQLAVVEFSRNVLGWQDANSTEFDPTTSHPVVVDMPEHNPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 240 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 241 - protein, 742 aa, Homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 242 - protein, 2364 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKHLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 243 - protein, 365 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 244 - protein, 562 aa, Homo sapiens
MVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 245 - protein, 365 aa, Homo sapiens; identical to SEQ ID NO: 243

SEQ ID NO: 246 - protein, 592 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 247 - protein, 332 aa, Homo sapiens
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 248 - protein, 630 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 249 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 250 - protein, 667 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 251 - protein, 1390 aa, Homo sapiens; identical to SEQ ID NO: 214

SEQ ID NO: 252 - protein, 395 aa, Homo sapiens
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISSEAVCKPLCARQSFTLAREACRSYSHVVLKEVRFFNLQVLYPLLSDPALNLRIVHLVRDPRAVLRSREQTAKALARDNGIVLGTNGTWVEADPGLRVVREVCRSHVRIAEAATLKPPPFLRGRYRLVRFEDLAREPLAEIRALYAFTGLSLTPQLEAWIHNITHGSGPGARREAFKTSSRNALNVSQAWRHALPFAKIRRVQELCAGALQLLGYRPVYSEDEQRNLALDLVLPRGLNGFTWASSTASHPRN

SEQ ID NO: 253 - protein, 381 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 254 - protein, 310 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 255 - protein, 742 aa, Homo sapiens; identical to SEQ ID NO: 240

SEQ ID NO: 256 - protein, 252 aa, Homo sapiens
MKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 257 - protein, 108 aa, Homo sapiens; identical to SEQ ID NO: 205

SEQ ID NO: 258 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVHATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLNTINCEEGDKLKLTSFELAPKSGNTGELRSVIHSHIKVIKTRKNKKDILNPDSSMETSPDFFF

SEQ ID NO: 259 - protein, 742 aa, Homo sapiens; identical to SEQ ID NO: 240

SEQ ID NO: 260 - protein, 729 aa, Homo sapiens; identical to SEQ ID NO: 258

SEQ ID NO: 261 - protein, 72 aa, Homo sapiens
MSSKTASTNNIAQARRTVQQLRLEASIERIKVSKASADLMSYCEEHARSDPLLIGIPTSENPFKDKKTCIIL

SEQ ID NO: 262 - protein, 210 aa, Homo sapiens
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKQ

SEQ ID NO: 263 - protein, 646 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQAWNLDTMISLLSEPQELLVNYVSDVRVSPAAPERQEGSSLTLTCEAESSQDLEFQWLREETDQVLERGPVLQLHDLKREAGGGYRCVASVPSIPGLNRTQLVKLAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKTELVVEVKSDKLPEEMGLLQGSSGDKRAPGDQGEKYIDLRH

SEQ ID NO: 264 - protein, 863 aa, Homo sapiens; identical to SEQ ID NO: 215

SEQ ID NO: 265 - protein, 729 aa, Homo sapiens; identical to SEQ ID NO: 258

SEQ ID NO: 266 - protein, 363 aa, Homo sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEGPGCCSDLAVSFHYVDSTTMYELEYLVYHLRPYGYLYRYQPTLPERILKEISQANKNEDTKVKLGNP

SEQ ID NO: 267 - protein, 186 aa, Homo sapiens [sequence omitted]

SEQ ID NO: 268 - protein, 640 aa, Homo sapiens
MAAGGTGGLREEQRYGLSCGRLGQDNITVLHVKLTETAIRALETYQSHKNLIPFRPSIQFQGLHGLVKIPKNDPLNEVHNFNFYLSNVGKDNPQGSFDCIQQTFSSSGASQLNCLGFIQDKITVCATNDSYQMTRERMTQAEEESRNRSTKVIKPGGPYVGKRVQIRKAPQAVSDTVPERKRSTPMNPANTIRKTHSSSTISQRPYRDRVIHLLALKAYKKPELLARLQKDGVNQKDKNSLGAILQQVANLNSKDLSYTLKDYVFKELQRDWPGYSEIDRRSLESVLSRKLNPSQNATGTSRSESPVCSSRDAVSSPQKRLLDSEFIDPLMNKKARISHLTNRVPPTLNGHLNPTSEKSAAGLPLPPAAAAIPTPPPLPSTYLPISHPPQIVNSNSNSPSTPEGRGTQDLPVDSFSQNDSIYEDQQDKYTSRTSLETLPPGSVLLKCPKPMEENHSMSHKKSKKKSKKHKEKDQIKKHDIETIEEKEEDLKREEEIAKLNNSSPNSSGGVKEDCTASMEPSAIELPDYLIKYIAIVSYEQRQNYKDDFNAEYDEYRALHARMETVARRFIKLDAQRKRLSPGSKEYQNVHEEVLQEYQKIKQSSPNYHEEKYRCEYLHNKLAHIKRLIGEFDQQQAESWS

SEQ ID NO: 269 - protein, 454 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 270 - protein, 1038 aa, Homo sapiens
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 271 - protein, 278 aa, Homo sapiens
MDKSGIDSLDHVTSDAVELANRSDNSSDSSLFKTQCIPYSPKGEKRNPIRKFVRTPESVHASDSSSDSSFEPIPLTIKAIFERFKNRKKRYKKKKKRRYQPTGRPRGRPEGRRNPIYSLIDKKKQFRSRGSGFPFLESENEKNAPWRKILTFEQAVARGFFNYIEKLKYEHHLKESLKQMNVGEDLENEDFDSRRYKFLDDDGSISPIEESTAEDEDATHLEDNECDIKLAGDSFIVSSEFPVRLSVYLEEEDITEEAALSKKRATKAKNTGQRGLKM

SEQ ID NO: 272 - protein, 584 aa, Homo sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 273 - protein, 162 aa, Homo sapiens
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 274 - protein, 489 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 275 - protein, 662 aa, Homo sapiens
MALITLRKNLYRLSDFQMHRALAALKNKPLNHVHKVVKERLCPWLCSRQPEPFGVKFHHAHCKKFHSKNGNDLHPLGGPVFSQVSDCDRLEQNVKNEESQMFYRRLSNLTSSEEVLSFISTMETLPDTMAAGALQRICEVEKKDGDQGLPKEILENSIFQALCFQFEKEPSQLSNTSLVTALQALILLHVDPQSSLLLNLVAECQNRLRKGGMEVRNLCILGESLITLHSSGCVTLELIINQLQGEKLETFTPEDIVALYRILQACTEKVDEHQTFLNKINNFSLSIVSNLSPKLISQMLTALVVLDQSQAFPLIIKLGKYVVRHVPHFTNEELRRVLEAFIYFGHHDTFFTKALEHRVAAVCLTLDPEVVCRVMEYCSRELILSKPILNAVAETFVCQTEKFSPRQISALMEPFGKLNYLPPNASALFRKLENVLFTHFNYFPPKSLLKLLHSCSLNECHPVNFLAKIFKPLFLQRLQGKESHLDTLSRAQLTQLFLASVLECPFYKGPKLLPKYQVKSFLTPCCSLETPVDSQLYRYVKIGLTNLLGARLYFAPKVLTPYCYTIDVEIKLDEEGFVLPSTANEDIHKRIALCIDGPKRFCSNSKHLLGKEAIKQRHLQLLGYQVVQIPYHEIGMLKSRRELVEYLQRKLFSQNTVHWLQE

SEQ ID NO: 276 - protein, 683 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 277 - protein, 1103 aa, Homo sapiens; identical to SEQ ID NO: 216

SEQ ID NO: 278 - protein, 341 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 279 - protein, 253 aa, Homo sapiens; identical to SEQ ID NO: 213

SEQ ID NO: 280 - protein, 355 aa, Homo sapiens
MRGVRAATAAAVAATAASGLSRREAGGRAGAAAAVVRPPGRKCGRCRRLANFPGRKRRRRRRKGLGATTGGCGEAVSSLHPAPHSPSSVRPAGRRARRQRRGAGSAERPMSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 281 - protein, 291 aa, Homo sapiens
MERNSSLWKNLIDEHPVCTTWKQEAEGAIYHLASILFVVGFMGGSGFFGLLYVFSLLGLGFLCSAVWAWVDVCAADIFSWNFVLFVICFMQFVHIAYQVRSITFAREFQVLYSSLFQPLGISLPVFRTIALSSEVVTLEKEHCYAMQGKTSIDKLSLLVSGRIRVTVDGEFLHYIFPLQFLDSPEWDSLRPTEEGIFQVTLTAETDCRYVSWRRKKLYLLFAQHRYISRLFSVLIGSDIADKLYALNDRVYIGKRYHYDIRLPNFYQMSTPEIRRSPLTQHFQNSRRYCDK

SEQ ID NO: 282 - protein, 365 aa, Homo sapiens
MVTTIVLGRRFIGSIVKEASQRGKVSLFRSILLFLTRFTVLTATGWSLCRSLIHLFRTYSFLNLLFLCYPFGMYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHFFFSKPLRILNILLLLEGAVIVYQLYSLMSSEKWHQTISLALILFSNYYAFFKLLRDRLVLGKAYSYSASPQRDLDHRFS

SEQ ID NO: 283 - protein, 219 aa, Homo sapiens
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 284 - protein, 527 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 285 - protein, 1210 aa, Homo sapiens [sequence omitted]

SEQ ID NO: 286 - protein, 798 aa, Homo sapiens
MASEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 287 - protein, 669 aa, Homo sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKLVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 288 - protein, 306 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQVQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 289 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTFLIKTVETRDGQVINETSQHHDDLE

SEQ ID NO: 290 - protein, 723 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLGEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTECPVRAVC

SEQ ID NO: 291 - protein, 437 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 292 - protein, 742 aa, Homo sapiens; identical to SEQ ID NO: 240

SEQ ID NO: 293 - protein, 672 aa, Homo sapiens
MADGSLTGGGLEAAAMAPERTGWAVEQELASLEKGLFQDEDSCSDCSYRDKPGSSLQSFMPEGKTFFPEIFQTNQLLFYERFRAYQDYILADCKASEVQEFTAEFLEKVLEPSGWRAVWHTNVFKVLVEITDVDFAALKAVVRLAEPYLCDSQVSTFTMECMKELLDLKEHRLPLQELWVVFDDSGVFDQTALAIEHVRFFYQNIWRSWDEEEEDEYDYFVRCVEPRLRLHYDILEDRVPSGLIVDYHNLLSQCEESYRKFLNLRSSLSNCNSDSEQENISMVEGLKLYSEMEQLKQKLKLIENPLLRYVFGYQKNSNIQAKGVRSSGQKITHVVSSTMMAGLLRSLLTDRLCQEPGEEEREIQFHSDPLSAINACFEGDTVIVCPGHYVVHGTFSIADSIELEGYGLPDDIVIEKRGKGDTFVDCTGADIKISGIKFVQHDAVEGILIVHRGKTTLENCVLQCETTGVTVRTSAEFLMKNSDLYGAKGAGIEIYPGSQCTLSDNGIHHCKEGILIKDFLDEHYDIPKISMVNNIIHNNEGYGVVLVKPTIFSDLQESAEDGTEENKALKIQTSGEPDVAERVDLEELIECATGKMELCARTDPSEQVEGNCEIVNELIAASTQKGQIKKKRLSELGITQADDNLMSQEMFVGIVGNQFKWNGKGSFGTFLF

SEQ ID NO: 294 - protein, 579 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 295 - protein, 252 aa, Homo sapiens; identical to SEQ ID NO: 256

SEQ ID NO: 296 - protein, 980 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRRLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKTRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 297 - protein, 341 aa, Homo sapiens; identical to SEQ ID NO: 278

SEQ ID NO: 298 - protein, 229 aa, Homo sapiens; identical to SEQ ID NO: 222

SEQ ID NO: 299 - protein, 303 aa, Homo sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 300 - protein, 443 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 301 - protein, 84 aa, Homo sapiens
MATMENKVICALVLVSMLALGTLAEAQTETCTVAPRERQNCGFPGVTPSQCANKGCCFDDTVRGVPWCFYPNTIDVPPEEECEF

SEQ ID NO: 302 - protein, 234 aa, Homo sapiens
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 303 - protein, 141 aa, Homo sapiens
MFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 304 - protein, 375 aa, Homo sapiens
PGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 305 - protein, 563 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 306 - protein, 500 aa, Homo sapiens
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 307 - protein, 627 aa, Homo sapiens
MEGLAGYVYKAASEGKVLTLAALLLNRSESDIRYLLGYVSQQGGQRSTPLIIAARNGHAKVVRLLLEHYRVQTQQTGTVRFDGYVIDGATALWCAAGAGHFEVVKLLVSHGANVNHTTVTNSTPLRAACFDGRLDIVKYLVENNANISIANKYDNTCLMIAAYKGHTDVVRYLLEQRADPNAKAHCGATALHFAAEAGHIDIVKELIKWRAAIVVNGHGMTPLKVAAESCKADVVELLLSHADCDRRSRIEALELLGASFANDRENYDIIKTYHYLYLAMLERFQDGDNILEKEVLPPIHAYGNRTECRNPQELESIRQDRDALHMEGLIVRERILGADNIDVSHPIIYRGAVYADNMEFEQCIKLWLHALHLRQKGNRNTHKDLLRFAQVFSQMIHLNETVKAPDIECVLRCSVLEIEQSMNRVKNISDADVHNAMDNYECNLYTFLYLVCISTKTQCSEEDQCKINKQIYNLIHLDPRTREGFTLLHLAVNSNTPVDDFHTNDVCSFPNALVTKLLLDCGAEVNAVDNEGNSALHIIVQYNRPISDFLTLHSIIISLVEAGAHTDMTNKQNKTPLDKSTTGVSEILLKTQMKMSLKCLAARAVRANDINYQDQIPRTLEEFVGFH

SEQ ID NO: 308 - protein, 337 aa, Homo sapiens
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 309 - protein, 696 aa, Homo sapiens
MAYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKRPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 310 - protein, 442 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRGLRCSWEGLAVLDSLLLTLLPQLQEAWQQRTPSPVPGG

SEQ ID NO: 311 - protein, 500 aa, Homo sapiens; identical to SEQ ID NO: 306

SEQ ID NO: 312 - protein, 497 aa, Homo sapiens
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKVQNGGIVTDTPASNHLPGWEDIESKIPLNMEEPPVEEPEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 313 - protein, 358 aa, Homo sapiens
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 314 - protein, 483 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 315 - protein, 172 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 316 - protein, 496 aa, Homo sapiens
MASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETRISNENYVPHGLKVVQCHSQGGLRSLMQLESRWRQHFLDSMQPKHLPQQWSVDHNHQKLLRKFGEDLPIQLS

SEQ ID NO: 317 - protein, 1949 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 318 - protein, 595 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 319 - protein, 500 aa, Homo sapiens; identical to SEQ ID NO: 306

SEQ ID NO: 320 - protein, 678 aa, Homo sapiens
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 321 - protein, 322 aa, Homo sapiens
MASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 322 - protein, 345 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 323 - protein, 472 aa, Homo sapiens
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 324 - protein, 756 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 325 - protein, 480 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASSTA

SEQ ID NO: 326 - protein, 586 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMYIDSIDLEKITETEDPVKFHEAWQKLCKADGILVPGGFGIRGTLGKLQAISWARTKKIPFLGVCLGMQLAVIEFARNCLNLKDADSTEFRPNAPVPLVIDMPEHNPGNLGGTMRLGIRRTVFKTENSILRKLYGDVPFIEERHRHRFEVNPNLIKQFEQNDLSFVGQDVDGDRMEIIELANHPYFVGVQFHPEFSSRPMKPSPPYLGLLLAATGNLNAYLQQGCKLSSSDRYSDASDDSFSEPRIAELEIS

SEQ ID NO: 327 - protein, 174 aa, Homo sapiens
MADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 328 - protein, 324 aa, Homo sapiens
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 329 - protein, 246 aa, Homo sapiens
MSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 330 - protein, 414 aa, Homo sapiens
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 331 - protein, 116 aa, Homo sapiens
  MISC_FEATURE (95)..(95): selenocysteine
MSFCSFFGGEVFQNHFEPGVYVCAKCGYELFSSRSKYAHSSPWPAFTETIHADSVAKRPEHNRSEALKVSCGKCGNGLGHEFLNDGPKPGQSRFXIFSSSLKFVPKGKETSASQGH

SEQ ID NO: 332 - protein, 483 aa, Homo sapiens
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKADPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 333 - protein, 402 aa, Homo sapiens [sequence omitted]

SEQ ID NO: 334 - protein, 185 aa, Homo sapiens
MRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 335 - protein, 637 aa, Homo sapiens
MRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 336 - protein, 469 aa, Homo sapiens
MDVENEQILNVNPADPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 337 - protein, 585 aa, Homo sapiens
MAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVGFVLGGFLSDAGWYSDAEKVFLSCLQLCTLHDEMLHWFRAVECCVRLLHVRNGNCKYHLGEETFKLAQTYMDKLSKHGQQANKAALYGELCALLFAKSHYDEAYKWCIEAMKEITAGLPVKVVVDVLRQASKACVVKREFKKAEQLIKHAVYLARDHFGSKHPKYSDTLLDYGFYLLNVDNICQSVAIYQAALDIRQSVFGGKNIHVATAHEDLAYSSYVHQYSSGKFDNALFHAERAIGIITHILPEDHLLLASSKRVKALILEEIAIDCHNKETEQRLLQEAHDLHLSSLQLAKKAFGEFNVQTAKHYGNLGRLYQSMRKFKEAEEMHIKAIQIKEQLLGQEDYEVALSVGHLASLYNYDMNQYENAEKLYLRSIAIGKKLFGEGYSGLEYDYRGLIKLYNSIGNYEKVFEYHNVLSNWNRLRDRQYSVTDALEDVSTSPQSTEEVVQSFLISQNVEGPSC

SEQ ID NO: 338 - protein, 505 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 339 - protein, 772 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKVEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGGVVCAVTISNPSRHVYTGGKGCVKIWDISQPGSKSPISQLDCLNRDNYMRSCKLHPDGRTLIVGGEGSTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPHKYQLHLHESCVLSLKFAYCGKWFVSTGKDNLLNAWRTPYGASISQSKESSSVLSCDISADDKYIVTGSGDKKATVYEVIY

SEQ ID NO: 340 - protein, 172 aa, Homo sapiens; identical to SEQ ID NO: 315

SEQ ID NO: 341 - protein, 1704 aa, Homo sapiens
MAVLRQLALLLWKNYTLQKRKVLVTVLELFLPLLFPGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPRELTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 342 - protein, 755 aa, Homo sapiens
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVMPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 343 - protein, 354 aa, Homo sapiens
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 344 - protein, 233 aa, Homo sapiens
MPCRREEEEEAGEEAEGEEEEDDSFLLLQQSVTLGSSGEVDRLVAQIGETLQLDAAQDSPASPCAPPGVPLRAPGPLAAAVPADKARPPAVPLLLPPASAETVGPAPSGALRCALGDRGRVRGRAAPYCVAEVAAGPSALPGPCRRGWLRDAVTSRRLQQRRWTQAGARAGDDDPHRLLQQLVLSGNLIKEAVRRLQRAVAAVAATGPASAPGPGGGRSGPDRIALQPSGSLL

SEQ ID NO: 345 - protein, 117 aa, Homo sapiens
MALETVPKDLRHLRACLLCSLVKTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 346 - protein, 533 aa, Homo sapiens
MGSRCLNPPPPAHSDTTGKDSFGNIRGAETGQGASACSVTSARVTCGAGSEPHSHRNPGISAQVGLAPSYGAARGRRRPLALQQSPQERRHVGWNSTRGLLPASLPGTASSQSASATASAALPLKVTGPLARNPTPPWTAAAALATRGQRPEKGLFPGPAPFSLGKRKRGRGRTWERRRRVSIETSTCFRPGCERLGAAAGANLSQLASSQRPLRERWVLYTIIMAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 347 - protein, 242 aa, Homo sapiens
MFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 348 - protein, 577 aa, Homo sapiens
MTELAGASSSCCHRPAGRGAMQSVLHHFQRLRGREGGSHFINTSSPRGEAKMSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 349 - protein, 469 aa, Homo sapiens
MEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPEKQLQVDQDYLIALSLQQQQPRGPLGLTDLELAQQLQQEEYQQQQAAQPVRMRTRVLSLQGRGATSGRPAGERRQRPKHESDCILL

SEQ ID NO: 350 - protein, 196 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 351 - protein, 384 aa, Homo sapiens
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKVSKDDRSDIESSSDEEDSEPPGKNPHTATTTNGTSGTNGYLLTGSCSMDD

SEQ ID NO: 352 - protein, 563 aa, Homo sapiens; identical to SEQ ID NO: 305

SEQ ID NO: 353 - protein, 130 aa, Homo sapiens
MQERTGAATARRESLPQANNPEQLCKQRCINEASWTMKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 354 - protein, 443 aa, Homo sapiens; identical to SEQ ID NO: 300

SEQ ID NO: 355 - protein, 358 aa, Homo sapiens
MESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 356 - protein, 391 aa, Homo sapiens
MDQCVTVERELEKVLHKFSGYGQLCERGLEELIDYTGGLKHEILQSHGQDAELSGTLSLVLTQCCKRIKDTVQKLASDHKDIHSSVSRVGKAIDKNFDSDISSVGIDGCWQADSQRLLNEVMVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCPMEQSPGDAKQIFF

SEQ ID NO: 357 - protein, 274 aa, Homo sapiens
MIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQSKKRRRVDGMQYYCS

SEQ ID NO: 358 - protein, 198 aa, Homo sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 359 - protein, 585 aa, Homo sapiens; identical to SEQ ID NO: 337

SEQ ID NO: 360 - protein, 453 aa, Homo sapiens
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 361 - protein, 353 aa, Homo sapiens
MAAPAQQTTQPGGGKRKGKAQYVLAKRARRCDAGGPRQLEPGLQGILITCNMNERKCVEEAYSLLNEYGDDMYGPEKFTDKDQQPSGSEGEDDDAEAALKKEVGDIKASTEMRLRRFQSVESGANNVVFIRTLGIEPEKLVHHILQDMYKTKKKKTRVILRMLPISGTCKAFLEDMKKYAETFLEPWFKAPNKGTFQIVYKSRNNSHVNREEVIRELAGIVCTLNSENKVDLTNPQYTVVVEIIKAVCCLSVVKDYMLFRKYNLQEVVKSPKDPSQLNSKQGNGKEAKLESADKSDQNNTAEGKNNQQVPENTEELGQTKPTSNPQVVNEGGAKPELASQATEGSKSNENDFS

SEQ ID NO: 362 - protein, 216 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 363 - protein, 97 aa, Homo sapiens
MEEISLANLDTNKLEAIAQEIYVDLIEDSCLGFCFEVHRAVKCGYFYLEFAETGSVKDFGIQPVEDKGACRLPLCSLPGEPGNGPDQQLQRSPPEFQ

SEQ ID NO: 364 - protein, 875 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 365 - protein, 117 aa, Homo sapiens
MSSNVPADMINLRLILVSGKTKEFLFSPNDSASDIAKHVYDNWPMDWEEEQVSSPNILRLIYQGRFLHGNVTLGALKLPFGKTTVMHLVARETLPEPNSQGQRNREKTGESNCCVIL

SEQ ID NO: 366 - protein, 260 aa, Homo sapiens
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 367 - protein, 395 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 368 - protein, 441 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 369 - protein, 101 aa, Homo sapiens
MRAGQQLASMLRWTRAWRLPREGLGPHGPSFARVPVAPSSSSGGRGGAEPRPLPLSYRLLDGEAALPAVVFLHGLFGSKTNFNSIAKILAQQTGRADGGCS

SEQ ID NO: 370 - protein, 687 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 371 - protein, 117 aa, Homo sapiens; identical to SEQ ID NO: 345

SEQ ID NO: 372 - protein, 248 aa, Homo sapiens
MSVSLPLTVMVRERDWIGIHLFSLYLSLPVGIPDFGSIWSDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 373 - protein, 259 aa, Homo sapiens
MDAWVRFSAQSQARERLCRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 374 - protein, 384 aa, Homo sapiens; identical to SEQ ID NO: 351

SEQ ID NO: 375 - protein, 385 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGIEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIEPVSINEENEGFEHNTQVRNQGIIALSYRDWEEIVKTFEISEPVITPSQRQQKPSA

SEQ ID NO: 376 - protein, 249 aa, Homo sapiens
MVDRLANSEANTRRISIVENCFGAAGQPLTIPGRVLIGEGVLTKLCRKKPKARQFFLFNDILVYGNIVIQKKKYNKQHIIPLENVTIDSIKDEGDLRNGWLIKTPTKSFAVYAATATEKSEWMNHINKCVTDLLSKSGKTPSNEHAAVWVPDSEATVCMRCQKAKFTPVNRRHHCRKCGFVVCGPCSEKRFLLPSQSSKPVRICDFCYDLLSAGDMATCQPARSDSYSQSLKSPLNDMSDDDDDDDSSD

SEQ ID NO: 377 - protein, 1190 aa, Homo sapiens
MTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLGLGLLINLVEYSARNRHCLVNMETSCSFDSSICSGEGDDSLRIGGQVHAVQALVQLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 378 - protein, 1230 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 379 - protein, 443 aa, Homo sapiens; identical to SEQ ID NO: 300

SEQ ID NO: 380 - protein, 885 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 381 - protein, 228 aa, Homo sapiens
MSYAEKPDEITKDEWMEKLNNLHVQRADMNRLIMNYLVTEGFKEAAEKFRMESGIEPSVDLETLDERIKIREMILKGQIQEAIALINSLHPELLDTNRYLYFHLQQQHLIELIRQRETEAALEFAQTQLAEQGEESRECLTEMERTLALLAFDSPEESPFGDLLHTMQRQKVWSEVNQAVLDYENRESTPKLAKLLKLLLWAQNELDQKKVKYPKMTDLSKGVIEEPK

SEQ ID NO: 382 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 383 - protein, 259 aa, Homo sapiens
MKHSKKTYDSFQDELEDYIKVQKARGLEPKTCFRKMKGDYLETCGYKGEVNSRPTYRMFDQRLPSETIQTYPRSCNIPQTVENRLPQWLPAHDSRLRLDSLSYCQFTRDCFSEKPVPLNFNQQEYICGSHGVEHRVYKHFSSDNSTSTHQASHKQIHQKRKRHPEEGREKSEEERSKHKRKKSCEEIDLDKHKSIQRKKTEVEIETVHVSTEKLKNRKEKKSRDVVSKKEERKRTKKKKEQGQERTEEEMLWDQSILGF

SEQ ID NO: 384 - protein, 187 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 385 - protein, 611 aa, Homo sapiens
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 386 - protein, 441 aa, Homo sapiens
MAVVPASLSGQDVGSFAYLTIKDRIPQILTKVIDTLHRHKSEFFEKHGEEGVEAEKKAISLLSKLRNELQTDKPFIPLVEKFVDTDIWNQYLEYQQSLLNESDGKSRWFYSPWLLVECYMYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 387 - protein, 114 aa, Homo sapiens
MAAIPSSGSLVATHDYYRRRLGSTSSNSSCSSTECPGEAIPHPPGLPKADPGHWWASFFFGKSTLPFMATVLESAEHSEPPQASSSMTACGLARDAPRKQPGGQSSTASAGPPS

SEQ ID NO: 388 - protein, 1015 aa, Homo sapiens
MRRFLRPGHDPVRERLKRDLFQFNKTVEHGFPHQPSALGYSPSLHILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAATFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERAATGVHIEPPWGAASAMAEQSEWLSVQAAR

SEQ ID NO: 389 - protein, 1291 aa, Homo sapiens
ARLSRWWVQDWTHGPIVRPPAAARTMWVNPEEVLLANALWITERANPYFILQRRKGHAGDGGGGGGLAGLLVGTLDVVLDSSARVAPYRILYQTPDSLVYWTIACGGSRKEITEHWEWLEQNLLQTLSIFENENDITTFVRGKIQGIIAEYNKINDVKEDDDTEKFKEAIVKFHRLFGMPEEEKLVNYYSCSYWKGKVPRQGWMYLSINHLCFYSFLMGREAKLVIRWVDITQLEKNATLLLPDVIKVSTRSSEHFFSVFLNINETFKLMEQLANIAMRQLLDNEGFEQDRSLPKLKRKSPKKVSALKRDLDARAKSERYRALFRLPKDEKLDGHTDCTLWTPFNKMHILGQMFVSTNYICFTSKEENLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGAINEKATHPGYYEDLVEKSMGKYNLATEEIERDLHRSLPEHPAFQNEMGIAALRRVLTAYAFRNPNIGYCQAMNIVTSVLLLYAKEEEAFWLLVALCERMLPDYYNTRVVGALVDQGVFEELARDYVPQLYDCMQDLGVISTISLSWFLTLFLSVMPFESAVVVVDCFFYEGIKVIFQLALAVLDANVDKLLNCKDDGEAMTVLGRYLDSVTNKDSTLPPIPHLHSLLSDDVEPYPEVDIFRLIRTSYEKFGTIRADLIEQMRFKQRLKVIQTLEDTTKRNVVRTIVTETSFTIDELEELYALFKAEHLTSCYWGGSSNALDRHDPSLPYLEQYRIDFEQFKGMFALLFPWACGTHSDVLASRLFQLLDENGDSLINFREFVSGLSAACHGDLTEKLKLLYKMHVLPEPSSDQDEPDSAFEATQYFFEDITPECTHVVGLDSRSKQGADDGFVTVSLKPDKGKRANSQENRNYLRLWTPENKSKSKNAKDLPKLNQGQFIELCKTMYNMFSEDPNEQELYHATAAVTSLLLEIGEVGKLFVAQPAKEGGSGGSGPSCHQGIPGVLFPKKGPGQPYVVESVEPLPASLAPDSEEHSLGGQMEDIKLEDSSPRDNGACSSMLISDDDTKDDSSMSSYSVLSAGSHEEDKLHCEDIGEDTVLVRSGQGTAALPRSTSLDRDWAITFEQFLASLLTEPALVKYFDKPVCMMARITSAKNIRMMGKPLTSASDYEISAMSG

SEQ ID NO: 390 - protein, 354 aa, Homo sapiens; identical to SEQ ID NO: 343

SEQ ID NO: 391 - protein, 541 aa, Homo sapiens
MGHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 392 - protein, 964 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 393 - protein, 825 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKSLQLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 394 - protein, 117 aa, Homo sapiens; identical to SEQ ID NO: 365

SEQ ID NO: 395 - protein, 251 aa, Homo sapiens
MEGGASAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

What is claimed is:

1. A method for treating breast cancer in a mammal in need thereof comprising:
    (a) measuring an expression level of an RNA transcript or its expression product in a breast cancer tissue biological sample from the mammal wherein the RNA transcript is an estrogen receptor 1 transcript;
    (b) determining a normalized expression level of the estrogen receptor 1 transcript or its expression product, wherein the normalized expression level of the estrogen receptor 1 transcript or its expression product negatively correlates with an increased likelihood of a beneficial response to said method of treatment; and
    (c) administering a microtubule-stabilizing agent comprising ixabepilone to said mammal when said mammal has said increased likelihood of said beneficial response.

2. The method of claim 1 wherein the breast cancer is invasive breast carcinoma.

* * * * *